US012612645B2

(12) United States Patent
Corey et al.

(10) Patent No.: US 12,612,645 B2
(45) Date of Patent: Apr. 28, 2026

(54) AAV VECTORS ENCODING MINI-PCDH15 AND USES THEREOF

(71) Applicants: President and Fellows of Harvard College, Cambridge, MA (US); Ohio State Innovation Foundation, Columbus, OH (US); Massachusetts Eye and Ear Infirmary, Boston, MA (US)

(72) Inventors: David P. Corey, Cambridge, MA (US); Artur Indzhykulian, Boston, MA (US); Marcos Sotomayor, Columbus, OH (US); Maryna V. Ivanchenko, Cambridge, MA (US); Cole W. D. Peters, Cambridge, MA (US)

(73) Assignees: President and Fellows of Harvard College, Cambridge, MA (US); Ohio State Innovation Foundation, Columbus, OH (US); Massachusetts Eye and Ear Infirmary, Boston, MA (US)

( * ) Notice: Subject to any disclaimer, the term of this patent is extended or adjusted under 35 U.S.C. 154(b) by 994 days.

(21) Appl. No.: 17/606,280

(22) PCT Filed: Apr. 24, 2020

(86) PCT No.: PCT/US2020/029968
§ 371 (c)(1),
(2) Date: Oct. 25, 2021

(87) PCT Pub. No.: WO2020/219990
PCT Pub. Date: Oct. 29, 2020

(65) Prior Publication Data
US 2022/0315948 A1     Oct. 6, 2022

Related U.S. Application Data

(60) Provisional application No. 62/839,543, filed on Apr. 26, 2019.

(51) Int. Cl.
| | |
|---|---|
| *C12N 15/86* | (2006.01) |
| *C07K 14/705* | (2006.01) |
| *C12N 15/90* | (2006.01) |
| *A61K 48/00* | (2006.01) |
| *C12N 15/113* | (2010.01) |

(52) U.S. Cl.
CPC ............ *C12N 15/86* (2013.01); *C07K 14/705* (2013.01); *C12N 15/90* (2013.01); *A61K 48/005* (2013.01); *C12N 15/1138* (2013.01); *C12N 2310/20* (2017.05); *C12N 2750/14143* (2013.01); *C12Y 305/04004* (2013.01)

(58) Field of Classification Search
CPC .... C12N 15/86; C12N 15/90; C12N 2310/20; C12N 15/1138; C12N 2750/14143; C07K 14/705; A61K 48/005; C12Y 305/04004
See application file for complete search history.

(56) References Cited

U.S. PATENT DOCUMENTS

| | | | |
|---|---|---|---|
| 5,399,363 | A | 3/1995 | Liversidge et al. |
| 5,478,745 | A | 12/1995 | Samulski et al. |
| 5,543,158 | A | 8/1996 | Gref et al. |
| 5,552,157 | A | 9/1996 | Yagi et al. |
| 5,565,213 | A | 10/1996 | Nakamori et al. |
| 5,567,434 | A | 10/1996 | Szoka, Jr. |
| 5,641,515 | A | 6/1997 | Ramtoola |
| 5,738,868 | A | 4/1998 | Shinkarenko |
| 5,741,516 | A | 4/1998 | Webb et al. |
| 5,795,587 | A | 8/1998 | Gao et al. |
| 6,001,650 | A | 12/1999 | Colosi |
| 6,156,303 | A | 12/2000 | Russell et al. |
| 10,167,457 | B2 | 1/2019 | Liu et al. |
| 11,167,042 | B2 * | 11/2021 | Stankovic ............. C12N 15/86 |
| 11,730,827 | B2 * | 8/2023 | Holt ................... A61K 48/0058 |
| | | | 424/93.2 |
| 2003/0138772 | A1 | 7/2003 | Gao et al. |
| 2013/0095071 | A1 | 4/2013 | Bance et al. |
| 2017/0037479 | A1 | 2/2017 | Kuznetsov et al. |
| 2018/0327779 | A1 | 11/2018 | Colella et al. |

(Continued)

FOREIGN PATENT DOCUMENTS

| | | |
|---|---|---|
| WO | WO 98/010088 A1 | 3/1998 |
| WO | WO 2016/139321 A1 | 9/2016 |

(Continued)

OTHER PUBLICATIONS

Perreault-Micale, Cynthia, et al. The Journal of Molecular Diagnostics 16.6 (2014): 673-678 (Year: 2014).*
Ostedgaard LS, et. al. Proc Natl Acad Sci U S A. Feb. 22, 2005;102(8):2952-7 (Year: 2005).*
Karpati et al., The principles of gene therapy in Duchenne muscular dystrophy. Clin Invest Med. Oct. 1994;17(5):499-509.
Invitation to Pay Additional Fees for Application No. PCT/US2020/029968, mailed Aug. 3, 2020.
International Search Report and Written Opinion for Application No. PCT/US2020/029968, mailed Oct. 5, 2020.
International Preliminary Report on Patentability for Application No. PCT/US2020/029968, mailed Nov. 4, 2021.

(Continued)

*Primary Examiner* — Marcia S Noble
*Assistant Examiner* — Zanna Maria Beharry
(74) *Attorney, Agent, or Firm* — Wolf, Greenfield & Sacks, P.C.

(57) ABSTRACT

Aspects of the disclosure relate to compositions, nucleic acids, vectors, viruses, and methods useful for treating hearing loss and/or blindness, for example, Usher Syndrome type IF. The present disclosure provides isolated nucleic acids, vectors, and rAAV.9.PHP.B comprising a transgene encoding a mini-PCDH15, and methods of treating hearing loss using the same. The present disclosure also provides a gRNA associated with a base editor to correct one or more mutations in PCDH15 for treating hearing loss and/or vision loss.

15 Claims, 20 Drawing Sheets

Specification includes a Sequence Listing.

(56) References Cited

U.S. PATENT DOCUMENTS

| | | |
|---|---|---|
| 2018/0369414 A1 | 12/2018 | Stankovic et al. |
| 2019/0153050 A1 | 5/2019 | Boye et al. |
| 2024/0016955 A1 | 1/2024 | Corey et al. |

FOREIGN PATENT DOCUMENTS

| | | |
|---|---|---|
| WO | WO 2017/193059 A1 | 11/2017 |
| WO | WO 2018/031683 A1 | 2/2018 |
| WO | WO 2018/145111 A1 | 8/2018 |
| WO | WO 2019/199689 A1 | 10/2019 |
| WO | WO 2020/079034 A2 | 4/2020 |
| WO | WO 2020/097372 A1 | 5/2020 |
| WO | WO 2020/198737 A1 | 10/2020 |

OTHER PUBLICATIONS

International Search Report and Written Opinion for Application No. PCT/US2021/050188, mailed Dec. 20, 2021.

Ahmad et al., Restoration of connexin26 protein level in the cochlea completely rescues hearing in a mouse model of human connexin30-linked deafness. Proc Natl Acad Sci U S A. Jan. 23, 2007;104(4):1337-41. doi: 10.1073/pnas.0606855104. Epub Jan. 16, 2007.

Ahmed et al., Mutations of the protocadherin gene PCDH15 cause Usher syndrome type 1F. Am J Hum Genet. Jul. 2001;69(1):25-34. doi: 10.1086/321277. Epub Jun. 7, 2001.

Ahmed et al., PCDH15 is expressed in the neurosensory epithelium of the eye and ear and mutant alleles are responsible for both USH1F and DFNB23. Hum Mol Genet. Dec. 15, 2003;12(24):3215-23. doi: 10.1093/hmg/ddg358. Epub Oct. 21, 2003.

Akil et al., Restoration of hearing in the VGLUT3 knockout mouse using virally mediated gene therapy. Neuron. Jul. 26, 2012;75(2):283-93. doi: 10.1016/j.neuron.2012.05.019.

Alagramam et al., Mutations in protocadherin 15 and cadherin 23 affect tip links and mechanotransduction in mammalian sensory hair cells. PLoS One. Apr. 21, 2011;6(4):e19183. doi: 10.1371/journal.pone.0019183.

Al-Moyed et al., A dual-AAV approach restores fast exocytosis and partially rescues auditory function in deaf otoferlin knock-out mice. EMBO Mol Med. Jan. 2019;11(1):e9396. doi: 10.15252/emmm.201809396.

Angueyra et al., Leveraging Zebrafish to Study Retinal Degeneration. Front Cell Dev Biol. Sep. 19, 2018;6:110. doi: 10.3389/fcell.2018.00110. eCollection 2018.

Araya-Secchi et al., An elastic element in the protocadherin-15 tip link of the inner ear. Nat Commun. Nov. 18, 2016;7:13458. doi: 10.1038/ncomms13458.

Assad et al., An active motor model for adaptation by vertebrate hair cells. J Neurosci. Sep. 1992;12(9):3291-309. doi: 10.1523/JNEUROSCI.12-09-03291.1992.

Assad et al., Tip-link integrity and mechanical transduction in vertebrate hair cells. Neuron. Dec. 1991;7(6):985-94. doi: 10.1016/0896-6273(91)90343-x.

Azaiez et al., Genomic Landscape and Mutational Signatures of Deafness-Associated Genes. Am J Hum Genet. Oct. 4, 2018;103(4):484-497. doi: 10.1016/j.ajhg.2018.08.006. Epub Sep. 20, 2018.

Ben-Yosef et al., A mutation of PCDH15 among Ashkenazi Jews with the type 1 Usher syndrome. N Engl J Med. Apr. 24, 2003;348(17):1664-70. doi: 10.1056/NEJMoa021502.

Bird et al., Harnessing molecular motors for nanoscale pulldown in live cells. Mol Biol Cell. Feb. 1, 2017;28(3):463-475. doi: 10.1091/mbc.E16-08-0583. Epub Dec. 8, 2016.

Boulay et al., Hearing is normal without connexin30. J Neurosci. Jan. 9, 2013;33(2):430-4. doi: 10.1523/JNEUROSCI.4240-12.2013.

Brownstein et al., The R245X mutation of PCDH15 in Ashkenazi Jewish children diagnosed with nonsyndromic hearing loss foreshadows retinitis pigmentosa. Pediatr Res. Jun. 2004;55(6):995-1000. doi: 10.1203/01.PDR.0000125258.58267.56. Epub Mar. 17, 2004.

Buenrostro et al., Transposition of native chromatin for fast and sensitive epigenomic profiling of open chromatin, DNA-binding proteins and nucleosome position. Nature Methods. Dec. 2013;10(12):1213-8. doi: 10.1038/nmeth.2688. Epub Oct. 6, 2013.

Burset et al., SpliceDB: database of canonical and noncanonical mammalian splice sites, Nucleic Acids Res. Jan. 1, 2001;29(1):255-9. doi: 10.1093/nar/29.1.255.

Chamberlain et al., Progress toward Gene Therapy for Duchenne Muscular Dystrophy. Mol Ther. May 3, 2017;25(5):1125-1131. doi: 10.1016/j.ymthe.2017.02.019. Epub Apr. 15, 2017.

Chang et al., Functional studies reveal new mechanisms for deafness caused by connexin mutations. Otol Neurotol. Feb. 2009;30(2):237-40. doi: 10.1097/MAO.0b013e318194f774.

Chang et al., Gap junction mediated intercellular metabolite transfer in the cochlea is compromised in connexin30 null mice. PloS One. 2008;3(12):e4088. doi: 10.1371/journal.pone.0004088. Epub Dec. 31, 2008.

Chang et al., Timed conditional null of connexin26 in mice reveals temporary requirements of connexin26 in key cochlear developmental events before the onset of hearing. Neurobiol Dis. Jan. 2015;73:418-27. doi: 10.1016/j.nbd.2014.09.005. Epub Sep. 22, 2014.

Chen et al., Characterization of a knock-in mouse model of the homozygous p.V37I variant in Gjb2. Sci Rep. Sep. 13, 2016;6:33279. doi: 10.1038/srep33279.

Chen et al., Developmental abnormalities in supporting cell phalangeal processes and cytoskeleton in the Gjb2 knockdown mouse model. Dis Model Mech. Feb. 26, 2018;11(2):dmm033019. doi: 10.1242/dmm.033019.

Chen et al., Down regulated connexin26 at different postnatal stage displayed different types of cellular degeneration and formation of organ of Corti. Biochem Biophys Res Commun. Feb. 28, 2014;445(1):71-7. doi: 10.1016/j.bbrc.2014.01.154. Epub Jan. 31, 2014.

Cheung et al., Ca2+ changes the force sensitivity of the hair-cell transduction channel. Biophys J. Jan. 1, 2006;90(1):124-39. doi: 10.1529/biophysj.105.061226. Epub Oct. 7, 2005.

Christensen et al., TRP channels in mechanosensation : Direct or indirect activation? Nat Rev Neurosci. Jul. 2007;8(7):510-21. doi: 10.1038/nrn2149.

Chylinski et al., The tracrRNA and Cas9 families of type II CRISPR-Cas immunity systems. RNA Biol. May 2013;10(5):726-37. doi: 10.4161/rna.24321. Epub Apr. 5, 2013.

Cohen-Salmon et al., Targeted ablation of connexin26 in the inner ear epithelial gap junction network causes hearing impairment and cell death. Curr Biol. Jul. 9, 2002;12(13):1106-11. doi: 10.1016/s0960-9822(02)00904-1.

Corey et al., Kinetics of the receptor current in bullfrog saccular hair cells. J Neurosci. May 1983;3(5):962-76. doi: 10.1523/JNEUROSCI.03-05-00962.1983.

Corey et al., TRPA1 is a candidate for the mechanosensitive transduction channel of vertebrate hair cells. Nature. Dec. 9, 2004;432(7018):723-30. doi: 10.1038/nature03066. Epub Oct. 13, 2004.

Creyghton et al., Histone H3K27ac separates active from poised enhancers and predicts developmental state. Proc Natl Acad Sci U S A. Dec. 14, 2010;107(50):21931-6. doi: 10.1073/pnas.1016071107. Epub Nov. 24, 2010.

Crispino et al., BAAV mediated GJB2 gene transfer restores gap junction coupling in cochlear organotypic cultures from deaf Cx26Sox10Cre mice. PloS One. 2011;6(8):e23279. doi: 10.1371/journal.pone.0023279. Epub Aug. 18, 2011.

Crispino et al., In vivo genetic manipulation of inner ear connexin expression by bovine adeno-associated viral vectors. Sci Rep. Aug. 4, 2017;7(1):6567. doi: 10.1038/s41598-017-06759-y.

Darcy et al. Dual adeno-associated viral Anc80 vector efficiently transduces inner ear cells in non-human primates. ARO Abstract 691. 2020; 43: 447-448.

Degen et al., Connexin32 can restore hearing in connexin26 deficient mice. Eur J Cell Biol. Oct. 2011;90(10):817-24. doi: 10.1016/j.ejcb.2011.05.001. Epub Aug. 2, 2011.

Del Castillo et al., A novel deletion involving the connexin-30 gene, del(GJB6-d13s1854), found in trans with mutations in the GJB2

(56) References Cited

OTHER PUBLICATIONS gene (connexin-26) in subjects with DFNB1 non-syndromic hearing impairment. J Med Genet. Jul. 2005;42(7):588-94. doi: 10.1136/jmg.2004.028324.

Del Castillo et al., DFNB1 Non-syndromic Hearing Impairment: Diversity of Mutations and Associated Phenotypes. Front Mol Neurosci. Dec. 22, 2017;10:428. doi: 10.3389/fnmol.2017.00428. eCollection 2017.

De-La-Torre et al., A Mechanically Weak Extracellular Membrane-Adjacent Domain Induces Dimerization of Protocadherin-15. Biophys J. Dec. 18, 2018;115(12):2368-2385. doi: 10.1016/j.bpj.2018.11. 010. Epub Nov. 16, 2018.

Deltcheva et al., CRISPR RNA maturation by trans-encoded small RNA and host factor 10 RNase III. Nature. Mar. 31, 2011;471(7340):602-7. doi: 10.1038/nature09886.

Derby et al., Gene transfer into the mammalian inner ear using HSV-1 and vaccinia virus vectors. Hear Res. Aug. 1999;134(1-2):1-8. doi: 10.1016/s0378-5955(99)00045-3.

Deverman et al., Cre-dependent selection yields AAV variants for widespread gene transfer to the adult brain. Nat Biotechnol. Feb. 2016;34(2):204-9. doi: 10.1038/nbt.3440. Epub Feb. 1, 2016.

Dinh et al., Diverse deafness mechanisms of connexin mutations revealed by studies using in vitro approaches and mouse models. Brain Res. Jun. 24, 2009;1277:52-69. doi: 10.1016/j.brainres.2009. 02.008. Epub Feb. 20, 2009.

Doucette et al., Profound, prelingual nonsyndromic deafness maps to chromosome 10q21 and is caused by a novel missense mutation in the Usher syndrome type IF gene PCDH15. Eur J Hum Genet. May 2009;17(5):554-64. doi: 10.1038/ejhg.2008.231. Epub Dec. 24, 2008.

Dyka et al., Dual adeno-associated virus vectors result in efficient in vitro and in vivo expression of an oversized gene, MYO7A. Hum Gene Ther Methods. Apr. 2014;25(2):166-77. doi: 10.1089/hgtb. 2013.212.

Ellis et al., A survey of ex vivo/in vitro transduction efficiency of mammalian primary cells and cell lines with Nine natural adeno-associated virus (AAV1-9) and one engineered adeno- associated virus serotype. Virol J. Mar. 6, 2013;10:74. doi: 10.1186/1743-422X-10-74.

Feigenspan et al., Expression of connexin36 in cone pedicles and OFF-cone bipolar cells of the mouse retina. J Neurosci. Mar. 31, 2004;24(13):3325-34. doi: 10.1523/JNEUROSCI.5598-03.2004.

Ferretti et al., Complete genome sequence of an M1 strain of *Streptococcus pyogenes*. Proc Natl Acad Sci U S A. Apr. 10, 2001;98(8):4658-63. doi: 10.1073/pnas.071559398.

Fetoni et al., Cx26 partial loss causes accelerated presbycusis by redox imbalance and dysregulation of Nfr2 pathway. Redox Biol. Oct. 2018;19:301-317. doi: 10.1016/j.redox.2018.08.002. Epub Aug. 7, 2018.

Forge et al., Gap junctions and connexin expression in the inner ear. Novartis Found Symp. 1999;219:134-50; discussion 151-6. doi: 10.1002/9780470515587.ch9.

Forge et al., Gap junctions in the inner ear: comparison of distribution patterns in different vertebrates and assessement of connexin composition in mammals. J Comp Neurol. Dec. 8, 2003;467(2):207-31. doi: 10.1002/cne.10916.

Garcia et al., Localization of myosin-Iβ near both ends of tip links in frog saccular hair cells. J Neurosci. Nov. 1, 1998;18(21):8637-47. doi: 10.1523/JNEUROSCI.18-21-08637.1998.

Gaudelli et al., Programmable base editing of A*T to G*C in genomic DNA without DNA cleavage. Nature. Nov. 23, 2017;551(7681):464-471. doi: 10.1038/nature24644. Epub Oct. 25, 2017.

Ge et al., Structure of mouse protocadherin 15 of the stereocilia tip link in complex with LHFPL5. Elife. Aug. 2, 2018;7:e38770. doi: 10.7554/eLife.38770.

Genbank Submission. NCBI; Accession No. NC_000010, version NC_000010.10. *Homo sapiens* chromosome 10, GRCh37.p13 Primary Assembly. Aug. 13, 2013. No Author Listed. 3 pages.

Genbank Submission. NCBI; Accession No. NM_001142763, version NM_001142763.2. *Homo sapiens* protocadherin related 15 (PCDH15), transcript variant A, mRNA. Jun. 29, 2021. Choudhary et al. 9 pages.

Genbank Submission. NCBI; Accession No. NM_001142763, version NM_001142763.1. *Homo sapiens* protocadherin related 15 (PCDH15), transcript variant A, mRNA. Apr. 23, 2019. Schrauwen et al. 9 pages.

Genbank Submission. NCBI; Accession No. NM_001142769, version NM_001142769.2. *Homo sapiens* protocadherin related 15 (PCDH15), transcript variant I, mRNA. May 4, 2019. Schrauwen et al. 9 pages.

Genbank Submission. NCBI; Accession No. NM_001142769, version NM_001142769.3. *Homo sapiens* protocadherin related 15 (PCDH15), transcript variant I, mRNA. Jun. 29, 2021. Choudhary et al. 9 pages.

Genbank Submission. NCBI; Accession No. NM_001142771, version NM_001142771.1. *Homo sapiens* protocadherin related 15 (PCDH15), transcript variant K, mRNA. Apr. 23, 2019. Schrauwen et al. 10 pages.

Genbank Submission. NCBI; Accession No. NM_001142771, version NM_001142771.2. *Homo sapiens* protocadherin related 15 (PCDH15), transcript variant K, mRNA. Jun. 29, 2021. Choudhary et al. 9 pages.

Genbank Submission. NCBI; Accession No. NM_001142772, version NM_001142772.1. *Homo sapiens* protocadherin related 15 (PCDH15), transcript variant L, mRNA. Apr. 23, 2019. Schrauwen et al. 10 pages.

Genbank Submission. NCBI; Accession No. NM_033056, version NM_033056.3. *Homo sapiens* protocadherin related 15 (PCDH15), transcript variant C, mRNA. Apr. 23, 2019. Schrauwen et al. 9 pages.

Genbank Submission. NCBI; Accession No. NP_001136235, version NP_001136235.1. protocadherin-15 isoform CD1-1 precursor [*Homo sapiens*]. Jun. 29, 2021. Choudhary et al. 5 pages.

Genbank Submission. NCBI; Accession No. NP_001136241, version NP_001136241.1. protocadherin-15 isoform CD2-1 precursor [*Homo sapiens*]. Jun. 29, 2021. Choudhary et al. 5 pages.

Genbank Submission. NCBI; Accession No. NP_001341349, version NP_001341349.1. protocadherin-15 isoform CD3-a precursor [*Homo sapiens*]. Jun. 29, 2021. Choudhary et al. 5 pages.

Gregorevic et al., rAAV6-microdystrophin preserves muscle function and extends lifespan in severely dystrophic mice. Nat Med. Jul. 2006;12(7):787-9. doi: 10.1038/nm1439. Epub Jul. 2, 2006.

Grimm et al., In vitro and in vivo gene therapy vector evolution via multispecies interbreeding and retargeting of adeno-associated viruses. J Virol. Jun. 2008;82(12):5887-911. doi: 10.1128/JVI.00254-08. Epub Apr. 9, 2008.

György et al., Allele-specific gene editing prevents deafness in a model of dominant progressive hearing loss. Nat Med. Jul. 2019;25(7):1123-1130. doi: 10.1038/s41591-019-0500-9. Epub Jul. 3, 2019.

György et al., Gene transfer with AAV9-PHP.B rescues hearing in a mouse model of usher syndrome 3A and transduces hair cells in a non-human primate. Mol Ther Methods Clin Dev. Nov. 20, 2018;13:1-13. doi: 10.1016/j.omtm.2018.11.003. eCollection Jun. 14, 2019.

György et al., Rescue of hearing by gene delivery to inner-ear hair cells using exosome-associated AAV. Mol Ther. Feb. 1, 2017;25(2):379-391. doi: 10.1016/j.ymthe.2016.12.010. Epub Jan. 9, 2017.

Hanlon et al., AAV-S: A novel AAV vector selected in brain transduces the inner ear with high efficiency. Mol Ther. Apr. 28, 2020; 18 (4S1): Abstract 151.

Hanlon et al., Selection of an Efficient AAV Vector for Robust CNS Transgene Expression. Mol Ther Methods Clin Dev. Oct. 23, 2019;15:320-332. doi: 10.1016/j.omtm.2019.10.007. eCollection Dec. 13, 2019.

Hasson et al., Unconventional myosins in inner-ear sensory epithelia J Cell Biol. Jun. 16, 1997;137(6):1287-307. doi: 10.1083/jcb. 137.6.1287.

(56) References Cited

OTHER PUBLICATIONS

Haywood-Watson et al., Ames Waltzer deaf mice have reduced electroretinogram amplitudes and complex alternative splicing of Pedh15 transcripts. Invest Ophthalmol Vis Sci. Jul. 2006;47(7):3074-84. doi: 10.1167/iovs.06-0108.

Hirsch et al., Delivering Transgenic DNA Exceeding the Carrying Capacity of AAV Vectors. Methods Mol Biol. 2016;1382:21-39. doi: 10.1007/978-1-4939-3271-9_2.

Holt et al., A chemical-genetic strategy demonstrates myosin 1c mediates sensory adaptation in hair cells. Cell. Feb. 8, 2002;108(3):371-81. doi: 10.1016/s0092-8674(02)00629-3.

Holt et al., Functional expression of exogenous proteins in mammalian sensory hair cells infected with adenoviral vectors. J Neurophysiol. Apr. 1999;81(4):1881-8. doi: 10.1152/jn.1999.81.4.1881.

Hrvatin et al., Single-cell analysis of experience-dependent transcriptomic states in the mouse visual cortex. Nat Neurosci. Jan. 2018;21(1):120-129. doi: 10.1038/s41593-017-0029-5. Epub Dec. 11, 2017.

Iizuka et al., Perinatal Gjb2 gene transfer rescues hearing in a mouse model of hereditary deafness. Hum Mol Genet. Jul. 1, 2015;24(13):3651-61. doi: 10.1093/hmg/ddv109. Epub Mar. 23, 2015.

Indzhykulian et al., Molecular remodeling of tip links underlies mechanosensory regeneration in auditory hair cells. PLoS Biol. 2013;11(6):e1001583. doi: 10.1371/journal.pbio.1001583. Epub Jun. 11, 2013.

Isgrig et al., AAV2.7m8 is a powerful viral vector for inner ear gene therapy. Nat Commun. Jan. 25, 2019;10(1):427. doi: 10.1038/s41467-018-08243-1.

Ivanchenko, Preclinical testing of AAV9-PHP.B for transgene expression in the non-human primate cochlea. Hear Res. Sep. 1, 2020;394:107930. doi: 10.1016/j.heares.2020.107930. Epub Feb. 26, 2020.

Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.

Johnson et al., Connexin-Mediated Signaling in Nonsensory Cells Is Crucial for the Development of Sensory Inner Hair Cells in the Mouse Cochlea. J Neurosci. Jan. 11, 2017;37(2):258-268. doi: 10.1523/JNEUROSCI.2251-16.2016.

Kamiya et al., Assembly of the cochlear gap junction macromolecular complex requires connexin 26. J Clin Invest. Apr. 2014;124(4):1598-607. doi: 10.1172/JCI67621. Epub Mar. 3, 2014.

Kazmierczak et al., Cadherin 23 and protocadherin 15 interact to form tip-link filaments in sensory hair cells. Nature. Sep. 6, 2007;449(7158):87-91. doi: 10.1038/nature06091.

Kelsell et al., Connexin 26 mutations in hereditary non-syndromic sensorineural deafness. Nature. May 1, 1997;387(6628):80-3. doi: 10.1038/387080a0.

Kenna et al., Audiologic phenotype and progression in GJB2 (Connexin 26) hearing loss. Arch Otolaryngol Head Neck Surg. Jan. 2010;136(1):81-7. doi: 10.1001/archoto.2009.202.

Kikuchi et al., Gap junctions in the rat cochlea: immunohistochemical and ultrastructural analysis. Anat Embryol (Berl) Feb. 1995;191(2):101-18. doi: 10.1007/BF00186783.

Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.

Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.

Kodippili et al., Dual AAV Gene Therapy for Duchenne Muscular Dystrophy with a 7-kb Mini-Dystrophin Gene in the Canine Model. Hum Gene Ther. Mar. 2018;29(3):299-311. doi: 10.1089/hum.2017.095. Epub Aug. 4, 2017.

Koehler et al., Generation of inner ear organoids containing functional hair cells from human pluripotent stem cells. Nat Biotechnol. Jun. 2017;35(6):583-589. doi: 10.1038/nbt.3840. Epub May 1, 2017.

Kohrman et al., Gene therapy for deafness. Gene Ther. Dec. 2013;20(12):1119-23. doi: 10.1038/gt.2013.39. Epub Jul. 18, 2013.

Komor et al., Programmable editing of a target base in genomic DNA without double-stranded DNA cleavage. Nature. May 19, 2016;533(7603):420-4. doi: 10.1038/nature17946. Epub Apr. 20, 2016.

Kwan et al., TRPA1 contributes to cold, mechanical, and chemical nociception but is not essential for hair-cell transduction. Neuron. Apr. 20, 2006;50(2):277-89. doi: 10.1016/j.neuron.2006.03.042.

Lang et al., Effects of chronic furosemide treatment and age on cell division in the adult gerbil inner ear. J Assoc Res Otolaryngol. Jun. 2003;4(2):164-75. doi: 10.1007/s10162-002-2056-4.

Lee et al., Mice with conditional deletion of Cx26 exhibit no vestibular phenotype despite secondary loss of Cx30 in the vestibular end organs. Hear Res. Oct. 2015;328:102-12. doi: 10.1016/j.heares.2015.07.018. Epub Jul. 29, 2015.

Levy et al., Cytosine and adenine base editing of the brain, liver, retina, heart and skeletal muscle of mice via adeno-associated viruses. Nat Biomed Eng. Jan. 2020;4(1):97-110. doi: 10.1038/s41551-019-0501-5. Epub Jan. 14, 2020.

Li et al., Characterization of slow-cycling cells in the mouse cochlear lateral wall. PLoS One. Jun. 20, 2017;12(6):e0179293. doi: 10.1371/journal.pone.0179293. eCollection 2017.

Li et al., Notch inhibition induces mitotically generated hair cells in mammalian cochleae via activating the Wnt pathway. Proc Natl Acad Sci U S A. Jan. 6, 2015;112(1):166-71. doi: 10.1073/pnas.1415901112. Epub Dec. 22, 2014.

Lin et al., Hearing loss and incident dementia. Arch Neurol. Feb. 2011;68(2):214-20. doi: 10.1001/archneurol.2010.362.

Lin et al., Hearing loss prevalence in the United States. Arch Intern Med. Nov. 14, 2011;171(20):1851-2. doi: 10.1001/archinternmed.2011.506.

Lukashkina et al., Amplification mode differs along the length of the mouse cochlea as revealed by connexin 26 deletion from specific gap junctions. Sci Rep. Jul. 12, 2017;7(1):5185. doi: 10.1038/s41598-017-04279-3.

Lustig et al., Cochlear Gene Therapy. Cold Spring Harb Perspect Med. Sep. 3, 2019;9(9):a033191. doi: 10.1101/cshperspect.a033191.

Ma et al., Connexin 26 in mature ears influences survival of hair cells and neurons. ARO Abstract 404. 2020; 43:258-9.

Maguire et al., Efficacy, Safety, and Durability of Voretigene Neparvovec-rzyl in RPE65 Mutation-Associated Inherited Retinal Dystrophy: Results of Phase 1 and 3 Trials. Ophthalmology. Sep. 2019;126(9):1273-1285. doi: 10.1016/j.ophtha.2019.06.017. Epub Jun. 22, 2019.

Mahendrasingam et al., Subcellular distribution and relative expression of fibrocyte markers in the CD/1 mouse cochlea assessed by semiquantitative immunogold electron microscopy. J Histochem Cytochem. Nov. 2011;59(11):984-1000. doi: 10.1369/0022155411421801.

Mason et al., Universal infant hearing screening by automated auditory brainstem response measurement. Pediatrics. Feb. 1998;101(2):221-8. doi: 10.1542/peds.101.2.221.

McLean et al., GREAT improves functional interpretation of cis-regulatory regions. Nat Biotechnol. May 2010;28(5):495-501. doi: 10.1038/nbt.1630. Epub May 2, 2010.

Mei et al., A deafness mechanism of digenic Cx26 (GJB2) and Cx30 (GJB6) mutations: Reduction of endocochlear potential by impairment of heterogeneous gap junctional function in the cochlear lateral wall. Neurobiol Dis. Dec. 2017;108:195-203. doi: 10.1016/j.nbd.2017.08.002. Epub Aug. 17, 2017.

Mutai et al., Mitotic activity and specification of fibrocyte subtypes in the developing rat cochlear lateral wall. Neuroscience. Nov. 10, 2009;163(4):1255-63. doi: 10.1016/j.neuroscience.2009.07.059. Epub Aug. 4, 2009.

Narui et al., Tuning Inner-Ear Tip-Link Affinity Through Alternatively Spliced Variants of Protocadherin-15. Biochemistry. Mar. 20, 2018;57(11):1702-1710. doi: 10.1021/acs.biochem.7b01075. Epub Mar. 6, 2018.

(56)             References Cited

OTHER PUBLICATIONS

Nickel et al., Gap junctions and connexins in the inner ear: their roles in homeostasis and deafness. Curr Opin Otolaryngol Head Neck Surg. Oct. 2008;16(5):452-7. doi: 10.1097/MOO.0b013e32830e20b0.

Olson et al., Post-translational tools expand the scope of synthetic biology. Curr Opin Chem Biol. Aug. 2012;16(3-4):300-6. doi: 10.1016/j.cbpa.2012.06.003. Epub Jul. 4, 2012.

Paige et al., RNA mimics of green fluorescent protein. Science. Jul. 29, 2011;333(6042):642-6. doi: 10.1126/science.1207339.

Pan et al., Gene therapy restores auditory and vestibular function in a mouse model of Usher syndrome type 1c. Nat Biotechnol. Mar. 2017;35(3):264-272. doi: 10.1038/nbt.3801. Epub Feb. 6, 2017.

Pepermans et al., The CD2 isoform of protocadherin-15 is an essential component of the tip-link complex in mature auditory hair cells. EMBO Mol Med. Jul. 2014;6(7):984-92. doi: 10.15252/emmm.201403976.

Plantier et al., A factor VIII minigene comprising the truncated intron I of factor IX highly improves the in vitro production of factor VIII. Thromb Haemost. Aug. 2001;86(2):596-603.

Powers et al., A Partial Calcium-Free Linker Confers Flexibility to Inner-Ear Protocadherin-15. Structure. Mar. 7, 2017;25(3):482-495. doi: 10.1016/j.str.2017.01.014. Epub Feb. 23, 2017.

Qi et al., Repurposing CRISPR as an RNA-Guided Platform for Sequence-Specific Control of Gene Expression. Cell. Feb. 28, 2013;152(5):1173-83. doi: 10.1016/j.cell.2013.02.022.

Rada-Iglesias et al., A unique chromatin signature uncovers early developmental enhancers in humans. Nature. Feb. 10, 2011;470(7333):279-83. doi: 10.1038/nature09692. Epub Dec. 15, 2010.

Rees et al., Base editing: precision chemistry on the genome and transcriptome of living cells. Nat Rev Genet. Dec. 2018;19(12):770-788. doi: 10.1038/s41576-018-0059-1.

Rodriguez-Paris et al., Comparative functional characterization of novel non-syndromic GJB2 gene variant p.Gly45Arg and lethal syndromic variant p.Gly45Glu. PeerJ. Oct. 11, 2016;4:e2494. doi: 10.7717/peerj.2494. eCollection 2016.

Sacheli et al., Gene transfer in inner ear cells: a challenging race. Gene Ther. Mar. 2013;20(3):237-47. doi: 10.1038/gt.2012.51. Epub Jun. 28, 2012.

Scheffer et al., Gene expression profiling identifies Hes6 as a transcriptional target of ATOH1 in cochlear hair cells. FEBS Lett. Oct. 2, 2007;581(24):4651-6. doi: 10.1016/j.febslet.2007.08.059. Epub Sep. 4, 2007.

Scheffer et al., The alpha1 subunit of nicotinic acetylcholine receptors in the inner ear: transcriptional regulation by ATOH1 and co-expression with the gamma subunit in hair cells. J Neurochem. Dec. 2007;103(6):2651-64. doi: 10.1111/j.1471-4159.2007.04980.x.

Scheffer et al., XIRP2, an actin-binding protein essential for inner ear hair-cell stereocilia. Cell Rep. Mar. 24, 2015;10(11):1811-8. doi: 10.1016/j.celrep.2015.02.042. Epub Mar. 12, 2015.

Senis et al., CRISPR/Cas9-mediated genome engineering: an adeno-associated viral (AAV) vector toolbox. Biotechnol J. Nov. 2014;9(11):1402-12. doi: 10.1002/biot.201400046. Epub Oct. 6, 2014.

Shepherd et al., The extent of adaptation in bullfrog saccular hair cells. J Neurosci. Oct. 1994;14(10):6217-29. doi: 10.1523/JNEUROSCI.14-10-06217.1994.

Shu et al., Identification of Adeno-Associated Viral Vectors That Target Neonatal and Adult Mammalian Inner Ear Cell Subtypes. Hum Gene Ther. Sep. 2016;27(9):687-99. doi: 10.1089/hum.2016.053. Epub Jun. 24, 2016.

Solc et al., Molecular cloning of myosins from the bullfrog saccular macula: A candidate for the adaptation motor. Auditory Neurosci. 1994; 1:63-75.

Sotomayor et al., A Partial Calcium-Free Linker Confers Flexibility to Inner-Ear Protocadherin-15. Structure. Mar. 7, 2017;25(3):482-495. doi: 10.1016/j.str.2017.01.014. Epub Feb. 23, 2017.

Sotomayor et al., In search of the hair-cell gating spring: Elastic properties of ankyrin and cadherin repeats. Structure. Apr. 2005;13(4):669-82. doi: 10.1016/j.str.2005.03.001.

Sotomayor et al., Structural determinants of cadherin-23 function in hearing and deafness. Neuron. Apr. 15, 2010;66(1):85-100. doi: 10.1016/j.neuron.2010.03.028.

Sun et al., Connexin30 null and conditional connexin26 null mice display distinct pattern and time course of cellular degeneration in the cochlea. J Comp Neurol. Oct. 20, 2009;516(6):569-79. doi: 10.1002/cne.22117.

Takada et al., Connexin 26 null mice exhibit spiral ganglion degeneration that can be blocked by BDNF gene therapy. Hearing Res. Mar. 2014;309:124-35. doi: 10.1016/j.heares.2013.11.009. Epub Dec. 12, 2013.

Trapani et al., Effective delivery of large genes to the retina by dual AAV vectors. EMBO Mol Med. Feb. 2014;6(2):194-211. doi: 10.1002/emmm.201302948. Epub Dec. 15, 2013.

Trapani et al., Seeing the Light after 25 Years of Retinal Gene Therapy. Trends Mol Med. Aug. 2018;24(8):669-681. doi: 10.1016/j.molmed.2018.06.006. Epub Jul. 5, 2018.

Trapani, Dual AAV Vectors for Stargardt Disease. Methods Mol Biol. 2018; 1715:153-175. doi: 10.1007/978-1-4939-7522-8_11.

Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015.

Vogl, Tryptophan-rich basic protein (WRB) mediates insertion of the tail-anchored protein otoferlin and is required for hair cell exocytosis and hearing. EMBO J. Dec. 1, 2016;35(23):2536-2552. doi: 10.15252/embj.201593565. Epub Jul. 25, 2016.

Wang et al., Targeted connexin26 ablation arrests postnatal development of the organ of Corti. Biochem Biophys Res Commun. Jul. 17, 2009;385(1):33-7. doi: 10.1016/j.bbrc.2009.05.023. Epub May 9, 2009.

Wassmer et al., Exosome-associated AAV2 vector mediates robust gene delivery into the murine retina upon intravitreal injection. Sci Rep. Mar. 31, 2017;7:45329. doi: 10.1038/srep45329.

Watanabe et al., Expression of the Sox10 gene during mouse inner ear development. Brain Res Mol Brain Res. Dec. 8, 2000;84(1-2):141-5. doi: 10.1016/s0169-328x(00)00236-9.

Wilch et al., A novel DFNB1 deletion allele supports the existence of a distant cis-regulatory region that controls GJB2 and GJB6 expression. Clin Genet. Sep. 2010;78(3):267-74. doi: 10.1111/j.1399-0004.2010.01387.x. Epub Mar. 1, 2010.

Wingard et al., Cellular and Deafness Mechanisms Underlying Connexin Mutation-Induced Hearing Loss—A Common Hereditary Deafness. Front Cell Neurosci. May 29, 2015;9:202. doi: 10.3389/fncel.2015.00202. eCollection 2015.

Wise et al., The effect of deafness duration on neurotrophin gene therapy for spiral ganglion neuron protection. Hearing Res. Aug. 2011;278(1-2):69-76. doi: 10.1016/j.heares.2011.04.010. Epub May 1, 2011.

Wu et al., Hair-cell mechanotransduction persists in TRP channel knockout mice. PloS One. May 19, 2016;11(5):e0155577. doi: 10.1371/journal.pone.0155577. eCollection 2016.

Xia et al., Expression of connexin 26 and Na,K-ATPase in the developing mouse cochlear lateral wall: functional implications. Brain Res. Oct. 30, 1999;846(1):106-11. doi: 10.1016/s0006-8993(99)01996-4.

Xiao et al., Rescue of the albino phenotype by introducing a functional tyrosinase minigene into Kunming albino mice. World J Gastroenterol. Jan. 14, 2007;13(2):244-9. doi: 10.3748/wjg.v13.i2.244.

Yang et al., Gfi1-Cre knock-in mouse line: A tool for inner ear hair cell-specific gene deletion. Genesis. Jun. 2010;48(6):400-6. doi: 10.1002/dvg.20632.

Yeh et al., In vivo base editing of post-mitotic sensory cells. Nature Commun. Jun. 5, 2018;9(1):2184. doi: 10.1038/s41467-018-04580-3.

Yeh et al., In vivo base editing rescues hearing in a mouse model of recessive deafness. ARO Abstract 172. 2020; 43:96-97.

(56) References Cited

OTHER PUBLICATIONS

Yu et al., Virally expressed connexin26 restores gap junction function in the cochlea of conditional Gjb2 knockout mice. Gene Ther. Jan. 2014;21(1):71-80. doi: 10.1038/gt.2013.59. Epub Nov. 14, 2013.

Zelante et al., Connexin26 mutations associated with the most common form of non-syndromic neurosensory autosomal recessive deafness (DFNB1) in Mediterraneans. Hum Mol Genet. Sep. 1997;6(9):1605-9. doi: 10.1093/hmg/6.9.1605.

Zhu et al., Active cochlear amplification is dependent on supporting cell gap junctions. Nature Commun. 2013;4:1786. doi: 10.1038/ncomms2806.

Extended European Search Report for Application No. 20794633.6, mailed Sep. 27, 2023.

International Preliminary Report on Patentability for Application No. PCT/US2021/050188, mailed Mar. 23, 2023.

Ahmed et al., Gene structure and mutant alleles of PCDH15: nonsyndromic deafness DFNB23 and type 1 Usher syndrome. Hum Genet. Oct. 2008;124(3):215-23. doi: 10.1007/s00439-008-0543-3. Epub Aug. 22, 2008.

Ivanchenko et al., Mini-PCDH15 gene therapy rescues hearing in a mouse model of Usher syndrome type 1F. Nat Commun. Apr. 26, 2023;14(1):2400. doi: 10.1038/s41467-023-38038-y.

Pepermans et al., The tip-link molecular complex of the auditory mechano-electrical transduction machinery. Hear Res. Dec. 2015;330(Pt A):10-7. doi: 10.1016/j.heares.2015.05.005. Epub Jun. 3, 2015.

Zhang et al., Cochlear Gene Therapy for Sensorineural Hearing Loss: Current Status and Major Remaining Hurdles for Translational Success. Front Mol Neurosci. Jun. 26, 2018:11:221. doi: 10.3389/fnmol.2018.00221. eCollection 2018.

Sotomayor et al., Structure of a force-conveying cadherin bond essential for inner-ear mechanotransduction. Nature. Dec. 6, 2012;492(7427):128-32. doi: 10.1038/nature11590. Epub Nov. 7, 2012.

Genbank Submission. NCBI; Accession No. NG_009115, version NG_009115.1. *Homo sapiens* rhodopsin (RHO), RefSeqGene on chromosome 3. Jan. 18, 2018. 7 pages.

* cited by examiner

Wt:      5′ CCAAAATCTGAATGAGAGGCGAACC 3′ (SEQ ID NO: 185)
R245X: 5′ CCAAAATCTGAATGAGAGGTGAACC 3′ (SEQ ID NO: 186)

R245X

(SEQ ID NO: 187)   Q  N  L  N  R  E  *  T

R245X: 3′ GGTTTTAGACTTACTCTCCACTTGG 5′ (SEQ ID NO: 188)

gRNA          GGTTTTAGACTTACTCTCCACTT  (SEQ ID NO: 189)

↓ ABEmax editing

ABEmax: 3′ GGTTTTAGACTTACTCTCCGCTTGG 5′ (SEQ ID NO: 190)

Editing at R245X

AAV VECTORS ENCODING MINI-PCDH15 AND USES THEREOF

RELATED APPLICATIONS

This application is a national stage filing under 35 U.S.C. § 371 of International PCT Application PCT/US2020/029968, filed Apr. 24, 2020, which claims priority under 35 U.S.C. § 119(e) to U.S. Provisional Application, U.S. Ser. No. 62/839,543, filed Apr. 26, 2019, entitled "AAV VECTORS ENCODING MINI-PCDH15 AND USES THEREOF," each of which is incorporated by reference herein.

FEDERALLY SPONSORED RESEARCH

This invention was made with Government support under DC016932 awarded by the National Institutes of Health. The Government has certain rights in the invention.

REFERENCE TO AN ELECTRONIC SEQUENCE LISTING

The contents of the electronic sequence listing (H082470334US01-SUBSEQ-TNG.txt; Size: 903,674 bytes; and Date of Creation: Oct. 21, 2025) are herein incorporated by reference in their entirety.

BACKGROUND

Mutations in PCDH15 cause Usher 1F, a recessive syndrome characterized by profound congenital deafness and absence of vestibular function, and progressive blindness beginning in the second decade. Because patients who lack hearing and balance rely on vision for communication and mobility, the late-onset blindness is particularly devastating.

Currently, treatment for Usher 1F is limited to cochlear implants, and there is no treatment for the related blindness. Gene addition therapy could be an attractive treatment for those with homozygous recessive mutations. However, the PCDH15 coding sequence of ~5.8 kb is too large to fit into a single AAV capsid, which is limited to ~4.7 kb of transgene.

Moreover, although conventional AAV vectors are safe and are currently used in clinical trials, none has led to efficient expression in most types of cells in the inner ear and the cells in the eye. In previous studies, AAVs transduced inner hair cells (IHCs) efficiently but not outer hair cells.

Therefore, it is of interest to develop a functional PCDH15 that would fit into a single AAV genome and an AAV serotype that can deliver a transgene to most types of cells in the inner ear and/or the cells in the eye for treatment of hearing loss and/or blindness (e.g., Usher Syndrome type 1F).

SUMMARY

The present disclosure, at least in part, relates to a recombinant Adeno-associated virus (rAAV) carrying an nucleic acid sequence (e.g., AAV genome) encoding a mini-PCDH15. Aspects of the disclosure relates to the design of a mini-PCDH15 that is small enough to fit into a single AAV genome for delivery into cells of the inner ear (e.g., inner hair cells, outer hair cells) across multiple species (e.g., human, mouse, rat, or non-human primates), for the treatment of hereditary hearing loss, for example, Usher syndrome type 1F.

Aspects of the disclosure provides an isolated nucleic acid including: (i) a first region comprising a first adeno-associated virus (AAV) inverted terminal repeat (ITR); and (ii) a second region comprising a transgene encoding a mini-Protocadherin related 15 (mini-PCDH15). In some aspects, the disclosure provides an isolated nucleic acid comprising a transgene flanked by adeno-associated virus (AAV) inverted terminal repeats (ITRs), wherein the transgene encodes a mini-Protocadherin related 15 (mini-PCDH15).

In some embodiments, the mini-PCDH15 transgene includes a truncated extracellular portion of a full length PCDH15. The full length PCDH15 comprises an extracellular domain as set forth in amino acid sequence of SEQ ID NO: 1.

In some embodiments, the mini-PCDH15 may not comprise one or more extracellular calcium-binding domains (EC) of the full-length PCDH15. In some examples, the mini-PCDH15 does not comprise amino acid residues 719 to 820 of SEQ ID NO: 1. In addition or alternatively, the mini-PCDH15 does not comprise amino acid residues 397 to 510 of SEQ ID NO: 1. In addition or alternatively, the mini-PCDH15 does not comprise amino acid residues 821 to 927 of SEQ ID NO: 1. In addition or alternatively, the mini-PCDH15 does not comprise amino acid residues 511 to 616 of SEQ ID NO: 1. In addition or alternatively, the mini-PCDH15 does not comprises amino acid residues 617 to 718 of SEQ ID NO: 1. In addition or alternatively, the mini-PCDH15 does not comprise amino acid residues 928 to 1036 of SEQ ID NO: 1. In addition or alternatively, the mini-PCDH15 does not comprise amino acid residues 1037 to 1145 of SEQ ID NO: 1. In addition or alternatively, the mini-PCDH15 does not comprise amino acid residues 266 to 397 of SEQ ID NO: 1.

In some embodiments, the mini-PCDH15 further comprises a transmembrane domain and a cytoplasmic domain. In some embodiments, the cytoplasmic domain of PCDH15 can be a splice isoform. In some embodiments, the splice isoform of PCDH15 can be CD1, CD2, or CD3 splice isoform. In some embodiments, the splice isoform comprises a transmembrane-intracellular domain having an amino acid sequence at least 80% identical to the amino acid sequence of SEQ ID NOs: 16, 59 or 60. In some embodiments, the mini-PCDH15 comprises an amino acid sequence at least 80% identical to amino acid sequence of SEQ ID NO: 31, 75, or 76. In some embodiments, the transgene encoding the mini-PCDH15 comprises a nucleic acid sequence at least 80% identical to nucleic acid sequence of SEQ ID NO: 32, 77, or 78. In some embodiments, the mini-PCDH15 comprises an amino acid sequence at least 80% identical to amino acid sequence of SEQ ID NO: 33, 79, or 80. In some embodiments, the transgene encoding the mini-PCDH15 comprises a nucleic acid sequence at least 80% identical to nucleic acid sequence of SEQ ID NO: 34, 81, or 82. In some embodiments, the mini-PCDH15 comprises an amino acid sequence at least 80% identical to amino acid sequence of SEQ ID NO: 35, 84, or 84. In some embodiments, the transgene encoding the mini-PCDH15 comprises a nucleic acid sequence at least 80% identical to nucleic acid sequence of SEQ ID NO: 36, 85, or 86. In some embodiments, the mini-PCDH15 comprises an amino acid sequence at least 80% identical to amino acid sequence of SEQ ID NO: 37, 87, or 88. In some embodiments, the transgene encoding the mini-PCDH15 comprises a nucleic acid sequence at least 80% identical to nucleic acid sequence of SEQ ID NO: 38, 89, or 90. In some embodiments, the mini-PCDH15 comprises an amino acid sequence at least 80% identical to amino acid sequence of SEQ ID NO: 39, 91, or 92. In some embodiments, the transgene encoding the mini-PCDH15 comprises a nucleic acid sequence at least 80% identical to nucleic acid sequence of SEQ ID NO: 40, 93, or 94. In some embodiments, the mini-PCDH15 comprises an amino acid sequence at least 80% identical to amino acid sequence of SEQ ID NO: 41, 95, or 96. In some embodiments, the transgene encoding the mini-PCDH15 comprises a nucleic acid sequence at least 80% identical to nucleic acid sequence of SEQ ID NO: 42, 97, or 98. In some embodiments, the mini-PCDH15 comprises an amino acid sequence at least 80% identical to amino acid sequence of SEQ ID NO: 43, 99, or 100. In some embodiments, the transgene encoding the mini-PCDH15 comprises a nucleic acid sequence at least 80% identical to nucleic acid sequence of SEQ ID NO: 44, 101, or 102. In some embodiments, the mini-PCDH15 comprises an amino acid sequence at least 80% identical to amino acid sequence of SEQ ID NO: 45, 103, or 104. In some embodiments, the transgene encoding the mini-PCDH15 comprises a nucleic acid sequence at least 80% identical to nucleic acid sequence of SEQ ID NO: 46, 105, or 106. In some embodiments, the mini-PCDH15 comprises an amino acid sequence at least 80% identical to amino acid sequence of SEQ ID NO: 71, 107, or 108. In some embodiments, the transgene encoding the mini-PCDH15 comprises a nucleic acid sequence at least 80% identical to nucleic acid sequence of SEQ ID NO: 72, 109, or 110. In some embodiments, the mini-PCDH15 comprises an amino acid sequence at least 80% identical to amino acid sequence of SEQ ID NO: 73, 111, or 112. In some embodiments, the transgene encoding the mini-PCDH15 comprises a nucleic acid sequence at least 80% identical to nucleic acid sequence of SEQ ID NO: 74, 113, or 114.

In some embodiments, the transgene further comprises a promoter operably linked to the transgene encoding the mini-PCDH15. One skilled in the art would understand any promoter can be used to drive expression of the mini-PCDH15. In some examples, the promoter can be a cytomegalovirus (CMV) promoter, a hybrid cytomegalovirus (CMV) immediate-early/chicken beta-actin promoter, or chicken beta-actin promoter (CAG). In other examples, the promoter is a native promoter. Exemplary native promoters include, but are not limited to, a Methyl-CpG Binding Protein 2 (MeCP2) promoter, a Ubiquitin-C (UbiC) promoter, a Bestrophin 1 (Best1) (retina native) promoter, a human red opsin (RedO) promoter, a human rhodopsin kinase (RK) promoter, a mouse cone arrestin (CAR) promoter, a human rhodopsin (Rho) promoter, a UV opsin-specific 1 (opn1sw1) promoter, a UV opsin-specific 2 (opn1sw2) promoter, an Opsin 1, Medium Wave Sensitive 2 (opn1mw2) promoter, an opsin 1, long-wave-sensitive 1 (opn1lw1) promoter, a blue cone specific promoter (sws2), an L-opsin (opn1lw1-cxxc1) promoter, a thyroid hormone receptor β (thrb) promoter, an LIM Homeobox 1a (lhx1a) promoter, a connexin 55.5 (cx55.5) promoter, a metabotropic glutamate receptor 6b (grm6b), a glial fibrillar acidic protein (gfap) promoter, a cone transducin alpha subunit (gnat2)promoter, a connexin 52.7 (cx52.7) promoter, a connexin 52.9 (cx52.9) promoter, a heat shock cognate 70-kd protein,-like (hsp70l) promoter, a yeast transcription activator protein-(GAL4-VP16) promoter, a upstream activation sequence (UAS), a visual system homeobox 1 (vsx1) promoter, or a rhodopsin (zop) promoter. In some embodiments, the promoter is a minimal promoter. In some examples, the minimal promoter can be minimal CMV promoter, CMV584 bp promoter or a Jet T promoter.

In some embodiments, the isolated nucleic acid further comprises a third region, and the third region comprises a second adeno-associated virus (AAV) inverted terminal repeat (ITR). In some embodiments, the first region and/or the third region is an AAV2 ITR.

Also provided herein are vectors comprising the isolated nucleic acid as described herein. In some embodiments, the vector is a plasmid, a viral vector (e.g., AAV vector, lentiviral vector). Also provided herein, can be a host cell comprising the isolated nucleic acid or the vector described herein.

In some embodiments, a recombinant adeno-associated virus (rAAV) includes (i) a capsid protein; and (ii) the isolated nucleic acid provided herein.

In some embodiments the capsid protein is AAV5, AAV7, AAV8 or AAV9 capsid protein, or a variant thereof. In some examples, the AAV capsid protein is AAV2.7m8 or AAV8BP2. In some examples, the AAV9 capsid variant is AAV9.PHP.B. In some examples, the capsid protein comprises an amino acid sequence at least 90% identical to amino acid sequence of SEQ ID NO: 47. In other examples, the capsid protein is exoAAV. In some examples, the exoAAV is exoAAV1 or exoAAV9. In another example, the capsid protein is Anc80.

In some embodiments, rAAV is a single-stranded AAV (ssAAV) or a self-complementary AAV (scAAV).

In some embodiments, the rAAV is capable of delivering the transgene to a mammal. In some embodiments, the mammal is a human. In other embodiments, the mammal is a non-human mammal. Exemplary non-human mammal can be mouse, rat, or non-human primate. In some embodiments, the rAAV is capable of delivering the transgene to the inner ear of retina of a mammal.

In some embodiments, the rAAV is formulated for delivery to the cochlea or the retina. Exemplary cells in cochlea can be outer hair cell (OHC), an inner hair cell (IHC), spiral ganglion neurons, stria vascularis, inner sulcus, spiral ligament, vestibular system. Exemplary cells in the eye can be photoreceptor cells, and other cells in the retina within the photoreceptor inner and outer segments (IS), outer plexiform layer (OPL), inner nuclei layer (INL), ganglion cell layer (GCL), inner plexiform layer (IPL), and retinal pigment epithelium (RPE) of the eye.

Another aspect of the present disclosure relates to a pharmaceutical composition comprising the rAAV described herein, and a pharmaceutically acceptable carrier.

Another aspect of the disclosure provides a kit for treating hearing loss and/or blindness comprising the isolated nucleic acid, the vector, or the rAAV described herein.

Aspects of the present disclosure provide a method for treating hearing loss and/or vision loss in a subject in need thereof comprising: administering to the subject an effective amount of the isolated nucleic acid, or the rAAV described herein. In some embodiments, the subject is a mammal. In some embodiments, the mammal is a human. In some embodiments, the mammal is a non-human mammal. In some embodiments, the non-human mammal is mouse, rat, or non-human primate.

In some embodiments, the subject has or is suspected of having Usher Syndrome type 1F. In some embodiments, the hearing loss and/or blindness is associated with Usher syndrome type 1F. In some embodiments, the hearing loss and/or blindness is associated with a mutation in the PCDH15 gene. In some embodiments, the mutation of PCDH15 gene is a point mutation, a missense mutation, a nonsense mutation, a deletion, an insertion, or a combination thereof. In some embodiments, the subject is human; and the mutation is one or more mutations in Table 1. In some embodiments, the subject is human; and the mutation comprises c.733C>T. In some embodiments, the mutation in the PCDH15 gene results in hearing loss and/or blindness. In some embodiments, the administration results in delivery of the isolated nucleic acid or rAAV to the ear or the eye of the subject. In some embodiments, the administration results in delivery of the isolated nucleic acid, vector, or rAAV to the cochlea or the retina of the subject. In some embodiments, the administration is via injection. In some embodiments, the injection is through round window membrane of the inner ear. In some embodiments, the administration is via subretinal or intravitreal injection to the eye.

Other aspects of the disclosure relates to a method for correcting a point mutation of PCDH15 in a target sequence including contacting the target sequence with a base editor and a guide RNA. Alternatively or in addition, the disclosure also provides a method for treating hearing loss and/or blindness in a subject in need thereof, comprising: administrating an effective amount of a base editor and a guide RNA. In some embodiments hearing loss and/or blindness is associated with Usher Syndrome type 1F. In some embodiments, the subject has or is suspected of having Usher Syndrome type 1F.

In some embodiments, the base editor comprises (i) a nucleic acid programmable DNA binding protein (napDNAbp), (ii) an adenosine deaminase capable of deaminating adenine in deoxyribonucleic acid (DNA) and (iii) a linker between (i) and (ii). In some embodiments the nucleic acid programmable DNA binding protein (napDNAbp) is a Cas9 domain. In some embodiments, the Cas9 domain is a nuclease dead Cas9 (dCas9) or a Cas9 nickase. In some embodiments, the adenosine deaminase is derived from a bacterium. In some embodiments, the adenosine deaminase is derived from *Escherichia coli*. In some embodiments, the adenosine deaminase is derived from TadA protein of *Escherichia coli*. In some embodiments, the base editor is ABEmax.

In some embodiments the point mutation of PCDH15 is associated with Usher syndrome type 1F. In some embodiments, the point mutation in PCDH15 is a point mutation. In some embodiments, the point mutation in PCDH15 is a point mutation in Table 1. In some embodiments, the point mutation in PCDH15 is c. 733C>T.

In some embodiments, the target sequence is in the genome of the subject. In some embodiments the subject is a mammal. In some embodiments, the mammal is a human. In some embodiments, the mammal is or a non-human mammal. In some embodiments, the human patient is an infant, a child or an adult.

In some embodiments, the guide RNA comprises a nucleic sequence at least 80% identical to nucleic acid sequence of SEQ ID NO: 51.

Also provided herein is a kit for treating hearing loss and/or blindness comprising: (i) the base editor; and (ii) the guide RNA as described herein.

The details of one or more embodiments of the invention are set forth in the description below. Other features or advantages of the present invention will be apparent from the following drawing and detailed description of certain embodiments, and also from the appended claims.

BRIEF DESCRIPTION OF DRAWINGS

FIG. 1A shows arrangement of the tip-link proteins PCDH15 and CDH23 and location at stereocilia tips. Each cadherin has multiple EC domains, strung like links in a chain. FIG. 1L is an illustration of single-molecule unbinding experimental design. FIG. 1P shows SEM photomicrographs of Pcdh15fl/fl,Gfi1-Cre- (upper) and Pcdh15fl/fl,Gfi1-Cre+ (lower) stereocilia bundles at P6.

FIG. 2A shows the A C>T mutation creates a stop codon in the coding strand (QNLNRE·T) (SEQ ID NO: 187). The reverse complement has a G>A mutation. The base editor, guided by the reverse complement gRNA, converts the A to G. FIG. 2B shows that ABE8e displays enhanced editing of the R245X mutation. FIG. 2C shows ABE8e editing in human USH1F patient induced pluripotent stem cells. FIG. 2D shows editing efficiencies with guide varieties. FIG. 2E shows base editing at R245X site using split-intein base editors. FIG. 2F shows editing of genomic loci with intein editors.

FIG. 3A shows robust eGFP expression in both IHCs and OHCs throughout the cochlea in C57BL/6 mice at P5 using ssAAV9-PHP.B-CMV584 bp-eGFP-noWPRE-BGHpolyA. FIG. 3B shows ABR results in Pcdh15fl/fl,Myo15-Cre+ mice using ssAAV9-PHP.B-CMV584 bp-miniPCDH15 v8-noWPRE-BGH-polyA. FIG. 3C shows ABR results in Pcdh15fl/fl,Myo15-Cre+ mice using ssAAV9-PHP.B-CMV584 bp-miniPCDH15 v4-noWPRE-BGHpolyA. FIGS. 3D-3E show ABR results in Pcdh15fl/fl,Myo15-Cre+ mice using ssAAV9-PHP.B-CMV584 bp-miniPCDH15 v7-noWPRE-BGHpolyA.

FIG. 5A shows structural modeling of the linkers between EC domains in mini-PCDH15 protein V4. FIG. 5B shows structural modeling of the linkers between EC domains in mini-PCDH15 protein V7. FIG. 5C shows structural modeling of the linkers between EC domains in mini-PCDH15 protein V8.

Figure 1A:
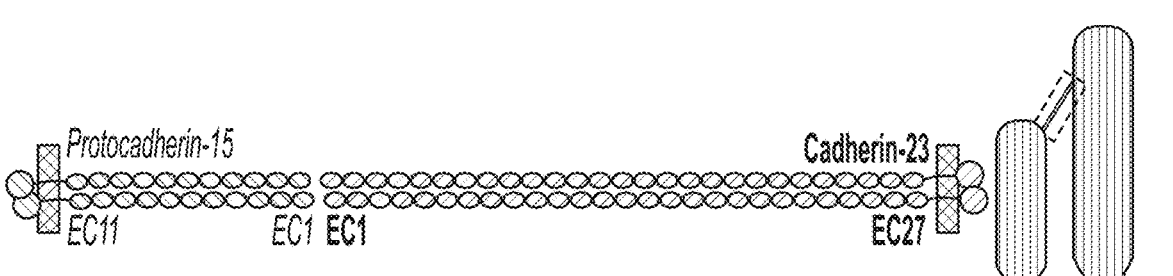
FIGS. 1A-1P are illustrations and pictures showing the design of mini-PCDH15 to fit into a single AAV genome, and the validation of mini-PCDH15 delivered by rAAV.

The accompanying drawings, which are incorporated in and constitute a part of this specification, illustrate certain embodiments, and together with the written description, serve to provide non-limiting examples of certain aspects of the compositions and methods disclosed herein.

DETAILED DESCRIPTION

In some aspects, the disclosure relates to compositions, nucleic acids, viruses, uses, and methods useful for treating certain genetic diseases, for example, autosomal recessive disorders, etc. Autosomal recessive disorders are diseases that result from abnormal expression or function of both alleles of a gene. Examples of autosomal recessive disorder include, but are not limited to, hereditary hearing loss (e.g., Usher syndrome Type 1F), Tay-Sachs disease, cystic fibrosis, sickle cell disease, autosomal recessive polycystic kidney disease (ARPKD), and phenylketonuria (PKU).

One aspect of the disclosure relates to delivering a functional therapeutic protein (e.g., PCDH15) to the target cells (e.g., inner hair cells, out hair cells and photoreceptors).

Adeno-associated virus (AAV) mediated gene therapy is one approach for the treatment of genetic diseases. Currently, treatment for Usher 1F is limited to cochlear implants, and there is no treatment for the blindness. Gene addition therapy could be an attractive treatment for those with homozygous recessive mutations. However, the PCDH15 coding sequence of ~5.8 kb is too large to fit into a single AAV capsid, which is limited to ~4.7 kb of transgene.

Moreover, although conventional AAV vectors are safe and are currently used in clinical trials, none has led to efficient expression in most types of hair cells. In previous studies, AAVs transduced inner hair cells (IHCs) efficiently but not outer hair cells.

The disclosure is based, in part, on gene therapy vectors, such as viral (e.g., rAAV) vectors, comprising one or more gene fragments encoding a therapeutic gene product, such as a protein or peptide (e.g., a mini-PCDH15) to the target cells (e.g., inner hair cells, outer hair cells, and photoreceptors).

A gene therapy vector may be a viral vector (e.g., a lentiviral vector, an adeno-associated virus vector, etc.), a plasmid, a closed-ended DNA (e.g., ceDNA), etc. In some embodiments, a gene therapy vector is a viral vector. In some embodiments, an expression cassette having a promoter operably linked to a transgene encoding a minigene (e.g., mini-PCDH15) is flanked by one or more viral replication sequences, for example, lentiviral long terminal repeats (LTRs) or adeno-associated virus (AAV) inverted terminal 5 repeats (ITRs).

As used herein, "minigene" refers to an isolated nucleic acid sequence encoding a recombinant peptide or protein where one or more non-essential elements of the corresponding gene encoding the naturally-occurring peptide or protein have been removed, and where the peptide or protein encoded by the minigene retains function of the corresponding naturally occurring peptide or protein. A "therapeutic minigene" refers to a minigene encoding a peptide or protein useful for treatment of a genetic disease, for example, protocadherin related 15 (PCDH15), dystrophin, dysferlin, Factor VIII, Amyloid precursor protein (APP), Tyrosinase (Tyr), etc. Minigenes are known in the art and are described, for example by Karpati and Acsadi (1994) Clin Invest Med 17(5):499-509; Plantier et al. (2001) Thromb Haemost. 86(2):596-603; and Xiao et al. (2007) World J. 15 Gastroenterol. 13(2):244-9.

I. Isolated Nucleic Acid

In some aspects, the disclosure provides isolated nucleic acids that are useful for expressing a mini-protocadherin related 15 (mini-PCDH15).

A "nucleic acid" sequence refers to a DNA or RNA sequence. In some embodiments, proteins and nucleic acids of the disclosure are isolated. As used herein, the term "isolated" means artificially produced. As used herein with respect to nucleic acids, the term "isolated" means: (i) amplified in vitro by, for example, polymerase chain reaction (PCR); (ii) recombinantly produced by cloning; (iii) purified, as by cleavage and gel separation; or (iv) synthesized by, for example, chemical synthesis. An isolated nucleic acid is one which is readily manipulable by recombinant DNA techniques well known in the art. Thus, a nucleotide sequence contained in a vector in which 5' and 3' restriction sites are known or for which polymerase chain reaction (PCR) primer sequences have been disclosed is considered isolated but a nucleic acid sequence existing in its native state in its natural host is not. An isolated nucleic acid may be substantially purified, but need not be. For example, a nucleic acid that is isolated within a cloning or expression vector is not pure in that it may comprise only a tiny percentage of the material in the cell in which it resides. Such a nucleic acid is isolated, however, as the term is used herein because it is readily manipulatable by standard techniques known to those of ordinary skill in the art.

The isolated nucleic acids of the invention may be recombinant adeno-associated virus (AAV) vectors (rAAV vectors). In some embodiments, an isolated nucleic acid as described by the disclosure comprises a region (e.g., a first region) comprising a first adeno-associated virus (AAV) inverted terminal repeat (ITR). The isolated nucleic acid (e.g., the recombinant AAV vector) may be packaged into a capsid protein and administered to a subject and/or delivered to a selected target cell. "Recombinant AAV (rAAV) vectors" are typically composed of, at a minimum, a transgene and its regulatory sequences (e.g., a promoter), and 5' and 3' AAV inverted terminal repeats (ITRs). The transgene may comprise, as disclosed elsewhere herein, a nucleic acid sequence encoding a protein (e.g., mini-PCDH15).

Aspects of the present disclosure relates to an isolated nucleic acid comprising a transgene encoding a mini-PCDH15. The wild type PCDH15 coding sequence of ~5.8 kb is too large to fit into a single AAV capsid, which is limited to ~4.7 kb of transgene. Full length PCDH15 is encoded by wild type PCDH15 coding sequence. PCDH15 gene is a member of the cadherin superfamily. Family members encode integral membrane proteins that mediate calcium-dependent cell-cell adhesion. Full-length PCDH15 includes (From N-terminus to C-terminus): a signal peptide, eleven extracellular calcium-binding domains (EC domains, EC1-EC11), a membrane adjacent domain (MAD12), a transmembrane domain and a unique cytoplasmic domain. PCDH15 is expressed in several isoforms differing in their cytoplasmic domains, suggesting that alternative splicing regulates PCDH15 function in hair cells. There are three prominent splice isoforms of PCDH15 according to its unique cytoplasmic domain: CD1, CD2, and CD3. PCDH15 plays an essential role in maintenance of normal retinal and cochlear function. It is thought to interact with cadherin related 23 (CDH23) to form tip-link filaments.

An exemplary full length human PCDH15 extracellular portion (signal peptide+eleven EC domains) amino acid sequence is set forth in SEQ ID NO: 1 (EC1, EC3, EC5, EC7, EC9, and EC11 in boldface; signal peptide, EC2, EC4, EC6, EC8, and EC10 in regular font):

```
                                      (SEQ ID NO: 1)
MFRQFYLWTCLASGIILGSLFEICLGQYDDDWQYEDCKLARGGPPATIVA

IDEESRNGTILVDNMLIKGTAGGPDPTIELSLKDNVDYWVLMDPVKQMLF

LNSTGRVLDRDPPMNIHSIVVQVQCINKKVGTIIYHEVRIVVRDRNDNSP

TFKHESYYATVNELTPVGTTIFTGFSGDNGATDIDDGPNGQIEYVIQYNP

DDPTSNDTFEIPLMLTGNIVLRKRLNYEDKTRYFVIIQANDRAQNLNERR

TTTTTLTVDVLDGDDLGPMFLPCVLVPNTRDCRPLTYQAAIPELRTPEEL

NPIIVTPPIQAIDQDRNIQPPSDRPGILYSILVGTPEDYPRFFHMHPRTA

ELSLLEPVNRDFHQKFDLVIKAEQDNGHPLPAFAGLHIEILDENNQSPYF

TMPSYQGYILESAPVGATISDSLNLTSPLRIVALDKDIEDTKDPELHLFL

NDYTSVFTVTQTGITRYLTLLQPVDREEQQTYTFSITAFDGVQESEPVIV

NIQVMDANDNTPTFPEISYDVYVYTDMRPGDSVIQLTAVDADEGSNGEIT

YEILVGAQGDFIINKTTGLITIAPGVEMIVGRTYALTVQAADNAPPAERR

NSICTVYIEVLPPNNQSPPRFPQLMYSLEISEAMRVGAVLLNLQATDREG

DSITYAIENGDPQRVFNLSETTGILTLGKALDRESTDRYILIITASDGRP

DGTSTATVNIVVTDVNDNAPVFDPYLPRNLSVVEEEANAFVGQVKATDPD

AGINGQVHYSLGNFNNLFRITSNGSIYTAVKLNREVRDYYELVVVATDGA

VHPRHSTLTLAIKVLDIDDNSPVFTNSTYTVLVEENLPAGTTILQIEAKD
```

```
                                       -continued
VDLGANVSYRIRSPEVKHFFALHPFTGELSLLRSLDYEAFPDQEASITFL

VEAFDIYGTMPPGIATVTVIVKDMNDYPPVFSKRIYKGMVAPDAVKGTPI

TTVYAEDADPPGLPASRVRYRVDDVQFPYPASIFEVEEDSGRVITRVNLN

EEPTTIFKLVVVAFDDGEPVMSSSATVKILVLHPGEIPRFTQEEYRPPPV

SELATKGTMVGVISAAAINQSIVYSIVSGNEEDTFGINNITGVIYVNGPL

DYETRTSYVLRVQADSLEVVLANLRVPSKSNTAKVYIEIQDENNHPPVFQ

KKFYIGGVSEDARMFTSVLRVKATDKDTGNYSVMAYRLIIPPIKEGKEGF

VVETYTGLIKTAMLFHNMRRSYFKFQVIATDDYGKGLSGKADVLVSVVNQ

LD
```

An exemplary nucleic acid sequence encoding full-length human PCDH15 extracellular portion:

```
                                          (SEQ ID NO: 2)
ATGTTTCGACAGTTTTATCTCTGGACATGTTTAGCTTCAG

GGATCATCCTGGGCTCTCTCTTTGAAATCTGCTTGGGCCA

GTATGATGATGACTGGCAATATGAGGATTGCAAACTAGCT

AGGGGAGGACCACCAGCTACCATAGTTGCTATTGATGAAG

AAAGTCGGAATGGTACAATTCTGGTGGACAACATGCTGAT

CAAAGGGACTGCTGGAGGACCAGACCCCACCATAGAACTT

TCTTTAAAGGATAATGTGGATTACTGGGTGTTGATGGATC

CTGTTAAGCAAATGCTTTTCCTGAACAGCACCGGAAGAGT

TCTGGATAGAGATCCACCGATGAACATACACTCCATTGTG

GTGCAGGTCCAGTGCATCAACAAAAAGTGGGCACTATTA

TCTACCATGAAGTGCGAATAGTGGTGAGAGACAGGAATGA

CAACTCACCCACTTTCAAGCATGAAAGCTACTATGCCACA

GTGAATGAGCTCACTCCAGTTGGTACCACAATATTCACAG

GATTTTCAGGAGACAATGGAGCTACAGATATAGATGATGG

ACCAAATGGACAGATAGAGTATGTTATTCAGTATAATCCA

GATGATCCGACATCCAATGACACCTTTGAAATTCCCCTAA

TGTTGACTGGAAATATAGTGTTAAGGAAGAGGCTCAACTA

TGAAGATAAGACTCGCTACTTTGTCATAATCCAAGCTAAT

GACCGTGCCCAAAATCTGAATGAGAGGCGAACCACCACCA

CCACTCTCACAGTGGATGTTCTGGATGGAGATGACTTGGG

TCCAATGTTTCTTCCTTGTGTCCTTGTGCCAAACACTCGT

GATTGCCGTCCACTCACTTATCAAGCTGCCATACCTGAGT

TGAGAACTCCGGAAGAACTGAACCCCATTATTGTTACGCC

ACCAATCCAAGCCATTGATCAGGACCGGAATATTCAACCG

CCATCAGATAGGCCAGGAATCCTCTATTCCATCCTTGTTG

GGACTCCTGAGGATTACCCACGATTTTTCCATATGCATCC

TAGGACAGCAGAACTTAGTCTCCTGGAGCCAGTAAACAGA

GACTTTCACCAGAAATTTGATTTGGTTATTAAGGCTGAAC

AAGACAATGGTCATCCTCTTCCTGCCTTTGCCGGTCTACA
```

-continued

```
CATTGAAATACTGGATGAAAACAATCAAAGTCCATATTTT

ACAATGCCCAGTTATCAAGGCTATATCCTGGAATCTGCCC

CAGTGGGAGCAACCATTTCGGACAGTCTCAATTTGACTTC

ACCTTTAAGAATAGTAGCTCTGGACAAGGACATAGAAGAT

ACAAAAGACCCAGAGCTTCACCTTTTTCTGAATGACTACA

CCTCAGTCTTCACCGTCACACAGACTGGTATTACTCGCTA

CCTCACCTTACTTCAACCAGTGGACAGGGAAGAACAGCAA

ACTTACACCTTTTCGATAACAGCATTTGATGGTGTACAAG

AAAGTGAGCCAGTCATCGTCAATATTCAAGTGATGGATGC

AAATGATAACACGCCAACCTTCCCTGAAATATCCTATGAT

GTGTATGTTTATACAGACATGAGACCTGGGGACAGTGTCA

TACAGCTCACTGCAGTCGACGCAGACGAAGGGTCAAATGG

GGAGATCACATATGAAATCCTTGTTGGGGCTCAGGGAGAC

TTCATCATCAATAAAACAACAGGGCTTATCACCATCGCTC

CAGGGGTGGAAATGATAGTCGGGCGGACTTACGCACTCAC

GGTCCAAGCAGCGGATAATGCTCCTCCTGCGAGCGAAGG

AACTCCATCTGCACTGTGTATATTGAAGTGCTTCCACCAA

ATAATCAAAGCCCTCCTCGCTTCCCACAGCTGATGTATAG

CCTTGAAATTAGTGAAGCCATGAGGGTTGGTGCTGTTTTA

TTAAATCTACAGGCAACTGATCGAGAGGGAGACTCAATAA

CATATGCCATTGAGAATGGAGATCCTCAGAGAGTTTTTAA

TCTTTCAGAAACCACGGGGATTCTAACCTTAGGGAAAGCA

CTGGACAGGGAAAGCACTGATCGCTACATTCTGATCATCA

CAGCTTCAGATGGCAGGCCAGATGGGACCTCAACTGCCAC

AGTAAACATAGTGGTGACAGATGTCAATGACAATGCTCCA

GTGTTTGATCCTTATCTGCCAAGAAATTTATCTGTGGTGG

AAGAAGAAGCCAATGCCTTTGTGGGTCAAGTAAAAGCAAC

AGACCCTGATGCTGGAATAAATGGTCAAGTGCACTACAGT

TTGGGTAACTTTAATAATCTTTTTCGTATCACATCCAATG

GGAGCATTTACACAGCAGTGAAGCTTAACAGAGAAGTCAG

GGACTACTATGAACTTGTTGTTGTGGCAACAGATGGAGCA

GTACACCCTCGTCATTCAACTCTAACCTTGGCCATCAAGG

TTTTGGACATTGATGATAACAGTCCTGTGTTCACCAATTC

AACATACACTGTCCTTGTTGAAGAGAATTTGCCAGCTGGG

ACTACCATCCTTCAAATAGAGGCCAAAGATGTCGACCTTG

GAGCAAATGTGTCTTACCGGATAAGAAGCCCAGAAGTGAA

GCACTTTTTTGCACTACATCCATTTACAGGAGAACTATCG

CTTTTTAAGGAGTTTAGATTATGAGGCATTTCCAGACCAAG

AAGCAAGTATCACTTTTCTGGTAGAGGCCTTTGATATTTA

TGGAACAATGCCACCTGGTATTGCTACTGTCACAGTGATT
```

-continued

```
GTAAAGGATATGAATGATTATCCTCCTGTCTTTAGTAAAC

GAATATACAAAGGGATGGTGGCTCCGGATGCAGTCAAGGG

TACACCTATCACAACAGTTTATGCTGAAGATGCAGACCCT

CCTGGATTACCTGCAAGTCGTGTGAGGTATAGAGTAGATG

ATGTACAGTTTCCTTACCCTGCCAGTATTTTTGAAGTGGA

AGAAGATTCTGGAAGAGTAATAACACGAGTCAATCTTAAT

GAAGAACCTACAACAATTTTTAAGTTGGTGGTGGTTGCTT

TTGATGATGGGGAGCCTGTGATGTCCAGCAGTGCCACAGT

GAAGATTCTTGTCTTACATCCTGGTGAGATCCCACGCTTC

ACACAGGAGGAATATAGACCTCCTCCAGTAAGTGAACTTG

CCACCAAAGGGACCATGGTTGGTGTAATTTCTGCTGCTGC

CATTAATCAAAGTATTGTGTACTCCATTGTTTCAGGAAAT

GAAGAAGATACATTTGGAATTAATAACATCACAGGTGTTA

TCTATGTGAATGGACCTCTGGATTATGAGACCAGGACAAG

CTATGTACTTCGAGTCCAAGCTGATTCCCTGGAAGTGGTC

CTTGCCAATCTCCGAGTTCCTTCAAAAAGCAATACAGCTA

AAGTATACATTGAGATTCAGGATGAAAATAATCATCCCCC

AGTGTTTCAGAAAAAATTCTACATCGGAGGTGTATCTGAA

GATGCAAGAATGTTTACTTCTGTACTCAGAGTGAAGGCTA

CTGATAAAGATACTGGCAATTATAGTGTCATGGCCTACAG

ACTCATAATACCACCAATTAAAGAGGGAAAAGAAGGATTT

GTAGTGGAAACATATACAGGGCTTATCAAAACTGCTATGC

TCTTCCATAATATGAGGAGATCCTACTTCAAGTTTCAAGT

TATTGCAACTGACGACTATGGGAAGGGACTGAGCGGCAAA

GCCGATGTACTCGTCTCCGTGGTCAATCAGCTGGAT
```

An exemplary amino acid sequence for full-length human PCDH15 (CD1 splice form cytoplasmic domain; EC1, EC3, EC5, EC7, EC9, EC11 and transmembrane-cytoplasmic domain in boldface; signal peptide, EC2, EC4, EC6, EC8, EC10 and MAD12 in regular font):

(SEQ ID NO: 53)

MFRQFYLWTCLASGIILGSLFEICLGQYDDDWQYEDCKLA

RGGPPATIVAIDEESRNGTILVDNMLIKGTAGGPDPTIEL

SLKDNVDYWVLMDPVKQMLFLNSTGRVLDRDPPMNIHSIV

VQVQCINKKVGTIIYHEVRIVVRDRNDNSPTFKHESYYAT

VNELTPVGTTIFTGFSGDNGATDIDDGPNGQIEYVIQYNP

DDPTSNDTFEIPLMLTGNIVLRKRLNYEDKTRYFVIIQAN

DRAQNLNERRTTTTTLTVDVLDGDDLGPMFLPCVLVPNTR

DCRPLTYQAAIPELRTPEELNPIIVTPPIQAIDQDRNIQP

PSDRPGILYSILVGTPEDYPRFFHMHPRTAELSLLEPVNR

DFHQKFDLVIKAEQDNGHPLPAFAGLHIEILDENNQSPYF

TMPSYQGYILESAPVGATISDSLNLTSPLRIVALDKDIED

-continued

TKDPELHLFLNDYTSVFTVTQTGITRYLTLLQPVDREEQQ

TYTFSITAFDGVQESEPVIVNIQVMDANDNTPTFPEISYD

VYVYTDMRPGDSVIQLTAVDADEGSNGEITYEILVGAQGD

FIINKTTGLITIAPGVEMIVGRTYALTVQAADNAPPAERR

NSICTVYIEVLPPNNQSPPRFPQLMYSLEISEAMRVGAVL

LNLQATDREGDSITYAIENGDPQRVFNLSETTGILTLGKA

LDRESTDRYILIITASDGRPDGTSTATVNIVVTDVNDNAP

VFDPYLPRNLSVVEEEANAFVGQVKATDPDAGINGQVHYS

LGNFNNLFRITSNGSIYTAVKLNREVRDYYELVVVATDGA

VHPRHSTLTLAIKVLDIDDNSPVFTNSTYTVLVEENLPAG

TTILQIEAKDVDLGANVSYRIRSPEVKHFFALHPFTGELS

LLRSLDYEAFPDQEAS ITFLVEAFDIYGTMPPGIATVTVI

VKDMNDYPPVFSKRIYKGMVAPDAVKGTPITTVYAEDADP

PGLPASRVRYRVDDVQFPYPASIFEVEEDSGRVITRVNLN

EEPTTIFKLVVVAFDDGEPVMSSSATVKILVLHPGEIPRF

TQEEYRPPPVSELATKGTMVGVISAAAINQSIVYSIVSGN

EEDTFGINNITGVIYVNGPLDYETRTSYVLRVQADSLEVV

LANLRVPSKSNTAKVYIEIQDENNHPPVFQKKFYIGGVSE

DARMFTSVLRVKATDKDTGNYSVMAYRLIIPPIKEGKEGF

VVETYTGLIKTAMLFHNMRRSYFKFQVIATDDYGKGLSGK

-continued

ADVLVSVVNQLDMQVIVSNVPPTLVEKKIEDLTEILDRYV

QEQIPGAKVVVESIGARRHGDAFSLEDYTKCDLTVYAIDP

QTNRAIDRNELFKFLDGKLLDINKDFQPYYGEGGRILEIR

TPEAVTSIKKRGESLGYTEGALLALAFIIILCCIPAILVV

LVSYRQFKVRQAECTKTARIQAALPAAKPAVPAPAPVAAP

PPPPPPPPGAHLYEELGDSSMHNLFLLYHFQQSRGNNSVS

EDRKHQQVVMPFSSNTIEAHKSAHVDGSLKSNKLKSARKF

TFLSDEDDLSAHNPLYKENISQVSTNSDISQRTDFVDPFS

PKIQAKSKSLRGPREKIQRLWSQSVSLPRRLMRKVPNRPE

IIDLQQWQGTRQKAENENTGICTNKRGSSNPLLTTEEANL

TEKEEIRQGETLMIEGTEQLKSLSSDSSFCFPRPHFSFST

LPTVSRTVELKSEPNVISSPAECSLELSPSRPCVLHSSLS

RRETPICMLPIETERNIFENFAHPPNISPSACPLPPPPPI

SPPSPPPAPAPLAPPPDISPFSLFCPPPSPPSIPLPLPPP

TFFPLSVSTSGPPTPPLLPPFPTPLPPPPPSIPCPPPPCS

ASFLSTECVITGVKCTTNLMPAEKIKSSMTQLSTTTVCKT

DPQREPKGILRHVKNLAELEKSVANMYSQIEKNYLRTNVS

ELQTMCPSEVTNMEITSEQNKGSLNNIVEGTEKQSHSQST

SL

An exemplary nucleic acid sequence encoding full-length human PCDH15 (CD1 splice form, NM_001142763.2, includes coding and non-coding regions):

(SEQ ID NO: 54)

ATGTTTCGACAGTTTTATCTCTGGACATGTTTAGCTTCAGGGATCATCCTGGGCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

-continued

```
GGTCTACACATTGAAATACTGGATGAAAACAATCAAAGTCCATATTTTACAATGCCCAGTTATC

AAGGCTATATCCTGGAATCTGCCCCAGTGGGAGCAACCATTTCGGACAGTCTCAATTTGACTTC

ACCTTTAAGAATAGTAGCTCTGGACAAGGACATAGAAGATACAAAAGACCCAGAGCTTCACCTT

TTTCTGAATGACTACACCTCAGTCTTCACCGTCACACAGACTGGTATTACTCGCTACCTCACCT

TACTTCAACCAGTGGACAGGGAAGAACAGCAAACTTACACCTTTTCGATAACAGCATTTGATGG

TGTACAAGAAAGTGAGCCAGTCATCGTCAATATTCAAGTGATGGATGCAAATGATAACACGCCA

ACCTTCCCTGAAATATCCTATGATGTGTATGTTTATACAGACATGAGACCTGGGGACAGTGTCA

TACAGCTCACTGCAGTCGACGCAGACGAAGGGTCAAATGGGGAGATCACATATGAAATCCTTGT

TGGGGCTCAGGGAGACTTCATCATCAATAAAACAACAGGGCTTATCACCATCGCTCCAGGGGTG

GAAATGATAGTCGGGCGGACTTACGCACTCACGGTCCAAGCAGCGGATAATGCTCCTCCTGCAG

AGCGAAGGAACTCCATCTGCACTGTGTATATTGAAGTGCTTCCACCAAATAATCAAAGCCCTCC

TCGCTTCCCACAGCTGATGTATAGCCTTGAAATTAGTGAAGCCATGAGGGTTGGTGCTGTTTTA

TTAAATCTACAGGCAACTGATCGAGAGGGAGACTCAATAACATATGCCATTGAGAATGGAGATC

CTCAGAGAGTTTTTAATCTTTCAGAAACCACGGGGATTCTAACCTTAGGGAAAGCACTGGACAG

GGAAAGCACTGATCGCTACATTCTGATCATCACAGCTTCAGATGGCAGGCCAGATGGGACCTCA

ACTGCCACAGTAAACATAGTGGTGACAGATGTCAATGACAATGCTCCAGTGTTTGATCCTTATC

TGCCAAGAAATTTATCTGTGGTGGAAGAAGAAGCCAATGCCTTTGTGGGTCAAGTAAAAGCAAC

AGACCCTGATGCTGGAATAAATGGTCAAGTGCACTACAGTTTGGGTAACTTTAATAATCTTTTT

CGTATCACATCCAATGGGAGCATTTACACAGCAGTGAAGCTTAACAGAGAAGTCAGGGACTACT

ATGAACTTGTTGTTGTGGCAACAGATGGAGCAGTACACCCTCGTCATTCAACTCTAACCTTGGC

CATCAAGGTTTTGGACATTGATGATAACAGTCCTGTGTTCACCAATTCAACATACACTGTCCTT

GTTGAAGAGAATTTGCCAGCTGGGACTACCATCCTTCAAATAGAGGCCAAAGATGTCGACCTTG

GAGCAAATGTGTCTTACCGGATAAGAAGCCCAGAAGTGAAGCACTTTTTTGCACTACATCCATT

TACAGGAGAACTATCGCTTTTAAGGAGTTTAGATTATGAGGCATTTCCAGACCAAGAAGCAAGT

ATCACTTTTCTGGTAGAGGCCTTTGATATTTATGGAACAATGCCACCTGGTATTGCTACTGTCA

CAGTGATTGTAAAGGATATGAATGATTATCCTCCTGTCTTTAGTAAACGAATATACAAAGGGAT

GGTGGCTCCGGATGCAGTCAAGGGTACACCTATCACAACAGTTTATGCTGAAGATGCAGACCCT

CCTGGATTACCTGCAAGTCGTGTGAGGTATAGAGTAGATGATGTACAGTTTCCTTACCCTGCCA

GTATTTTTGAAGTGGAAGAAGATTCTGGAAGAGTAATAACACGAGTCAATCTTAATGAAGAACC

TACAACAATTTTTAAGTTGGTGGTGGTTGCTTTTGATGATGGGGAGCCTGTGATGTCCAGCAGT

GCCACAGTGAAGATTCTTGTCTTACATCCTGGTGAGATCCCACGCTTCACACAGGAGGAATATA

GACCTCCTCCAGTAAGTGAACTTGCCACCAAAGGGACCATGGTTGGTGTAATTTCTGCTGCTGC

CATTAATCAAAGTATTGTGTACTCCATTGTTTCAGGAAATGAAGAAGATACATTTGGAATTAAT

AACATCACAGGTGTTATCTATGTGAATGGACCTCTGGATTATGAGACCAGGACAAGCTATGTAC

TTCGAGTCCAAGCTGATTCCCTGGAAGTGGTCCTTGCCAATCTCCGAGTTCCTTCAAAAAGCAA

TACAGCTAAAGTATACATTGAGATTCAGGATGAAAATAATCATCCCCCAGTGTTTCAGAAAAAA

TTCTACATCGGAGGTGTATCTGAAGATGCAAGAATGTTTACTTCTGTACTCAGAGTGAAGGCTA

CTGATAAAGATACTGGCAATTATAGTGTCATGGCCTACAGACTCATAATACCACCAATTAAAGA

GGGAAAAGAAGGATTTGTAGTGGAAACATATACAGGGCTTATCAAAACTGCTATGCTCTTCCAT

AATATGAGGAGATCCTACTTCAAGTTTCAAGTTATTGCAACTGACGACTATGGGAAGGGACTGA
```

-continued

GCGGCAAAGCCGATGTACTCGTCTCCGTGGTCAATCAGCTGGATATGCAAGTCATTGTTTCCAA

TGTGCCTCCTACTCTAGTGGAAAAAAAGATAGAAGATCTTACAGAGATCTTGGATCGCTATGTT

CAGGAACAAATTCCTGGTGCCAAGGTCGTAGTGGAGTCCATTGGAGCTCGCCGGCATGGAGATG

CCTTTTCCCTAGAAGATTACACCAAATGTGACTTGACTGTCTATGCAATTGACCCCCAAACCAA

CAGAGCCATCGATAGAAATGAGCTTTTTAAATTTTTGGATGGCAAACTACTTGATATCAATAAA

GACTTTCAGCCGTATTATGGGGAAGGAGGACGCATTCTGGAGATCCGGACTCCAGAGGCAGTGA

CCAGCATTAAAAAGAGAGGAGAAAGTCTAGGATACACAGAAGGGGCCTTGTTGGCTCTGGCCTT

CATCATCATCCTCTGCTGCATTCCTGCCATCTTGGTGGTTTTGGTCAGCTACAGACAGTTTAAA

GTACGTCAAGCTGAGTGTACAAAGACTGCACGAATTCAGGCCGCATTACCCGCGGCTAAACCAG

CAGTGCCGGCTCCTGCACCAGTGGCAGCGCCCCCGCCGCCGCCGCCGCCTCCGCCAGGTGCGCA

TCTCTATGAAGAACTTGGAGACAGCTCAATGCATAATCTTTTCCTTCTCTACCATTTTCAACAA

AGCAGGGGAAATAACTCAGTCTCAGAAGACAGGAAACATCAACAAGTTGTGATGCCCTTTTCTT

CCAATACTATTGAGGCTCACAAGTCAGCTCATGTAGACGGATCACTTAAGAGCAACAAACTGAA

GTCTGCAAGAAAATTCACATTTCTATCTGATGAGGATGACTTAAGTGCCCATAATCCCCTTTAT

AAGGAAAACATAAGTCAAGTATCAACAAATTCAGACATTTCACAGAGAACAGATTTTGTAGACC

CATTTTCACCCAAAATACAAGCCAAGAGTAAGTCTCTGAGGGGCCCAAGAGAAAAGATTCAGAG

GCTGTGGAGTCAGTCAGTCAGCTTACCCAGGAGGCTGATGAGGAAAGTTCCAAATAGACCAGAG

ATCATAGATCTGCAGCAGTGGCAAGGCACCAGGCAGAAAGCTGAAAATGAAAACACTGGAATCT

GTACAAACAAAAGAGGTAGCAGCAATCCATTGCTTACAACTGAAGAGGCAAATTTGACAGAGAA

AGAGGAAATAAGGCAAGGTGAAACACTGATGATAGAAGGAACAGAACAGTTGAAATCTCTCTCT

TCAGACTCTTCATTTTGCTTTCCCAGGCCTCACTTCTCATTCTCCACTTTGCCAACTGTTTCAA

GAACTGTGGAACTCAAATCAGAACCTAATGTCATCAGTTCTCCTGCTGAGTGTTCCTTGGAACT

TTCTCCTTCAAGGCCTTGTGTTTTACATTCTTCACTCTCTAGGAGAGAGACACCTATTTGTATG

TTACCTATTGAAACCGAAAGAAATATTTTTGAAAATTTTGCCCATCCACCAAACATCTCTCCTT

CTGCCTGTCCCCTTCCCCCTCCTCCTCCTATTTCTCCTCCTTCTCCTCCTCCTGCTCCTGCTCC

TCTTGCTCCTCCTCCTGACATTTCTCCTTTTTCTCTTTTTTGTCCTCCTCCCTCTCCTCCTTCT

ATCCCTCTTCCTCTTCCTCCTCCTACATTTTTTTCCACTTTCCGTTTCAACGTCTGGTCCCCCAA

CACCACCTCTTCTACCTCCATTTCCAACTCCTCTTCCTCCACCACCTCCTTCTATTCCTTGCCC

TCCACCTCCTTCAGCTTCATTTCTGTCCACAGAGTGTGTCTGTATAACAGGTGTTAAATGCACG

ACCAACTTGATGCCTGCCGAGAAAATTAAGTCCTCTATGACACAGCTATCAACAACGACAGTGT

GTAAAACAGACCCTCAGAGAGAACCAAAAGGCATCCTCAGACACGTTAAAAACTTAGCAGAACT

TGAAAAATCAGTAGCTAACATGTACAGTCAAATAGAAAAAAACTATCTACGCACAAATGTTTCA

GAACTTCAAACTATGTGCCCTTCAGAAGTAACAAATATGGAAATCACATCTGAACAAAACAAGG

GGAGTTTGAACAATATTGTCGAGGGAACTGAAAAACAATCTCACAGTCAATCTACTTCACTGTA

ATGTTGCTTTTCTTATTTTAGTCGGGCAAACCTCTTGTTGATCATAGTCTTCAAGTTGAACATC

AAATTTGAACGTCAAAGAAGACTCTATTATTTTACCCCAAATTCAATGAAATGCAGTTTTTTTT

CTCGTTTTTAATTTAAAAAGATATTAACCTCATCACTACTAACTCACTCATATAATAGATTTAC

CTTACTTTTTAAAAACTACAAAGTAGCATAATTTGTTCTACATTTATTTGAAAAGTAAGTAATT

TTAATCTCTTTTTTTAGTGGGAATATGTGGGCATGAAAATTAGATACCCAACTTAAACCAAAGGC

ATGTCTATCATGTGGATGCAGTAACATTTACATTTAGTTTTTTGATCGTAGTTTTATATGAATGT

TCCAAGAAAAAAGCAGACTGTTACAAATAAGTTAAAACTGATATGATTGATAGGTTCTGTTTTT

-continued

```
TCTTGAAGCCTATGTATTTGGTAAGAAGAAATACTACCGAAGTAAAATATAATGTACCTAGATT

GTAGGAGATGACAGACATAAGGTATTTCAAAATAAATCTCAGGTGCTATAACATGTAGTCATCT

GTTTTCTGATAAGAACATCTTTTACTCTGACTTGCTTTTATCTTAGTAGTATGCTTATGGATTT

AGTAGTATGCTTATGGATTTGATAAATCTTATACTTTTTCAGTTGCTGTCTTATTCTCTTTATT

TCTCATTGTGCTTTCCCTTCCCTTCTTTATAATGAAAATAAATCTTGAGTCGTTG
```

An exemplary amino acid sequence for full-length human PCDH15 (CD2 splice form cytoplasmic domain; EC1, EC3, EC5, EC7, EC9, EC11 and transmembrane-cytoplasmic domain in boldface; signal peptide, EC2, EC4, EC6, EC8, EC10 and MAD12 in regular font). EC4 domain of the CD2 splice variant contains an additional 7 amino acid (italics) sequences compared to other splice forms:

(SEQ ID NO: 55)

```
MFRQFYLWTCLASGIILGSLFEICLGQYDDDWQYEDCKLARGGPPATIVA

IDEESRNGTILVDNMLIKGTAGGPDPTIELSLKDNVDYWVLMDPVKQMLF

LNSTGRVLDRDPPMNIHSIVVQVQCINKKVGTIIYHEVRIVVRDRNDNSP

TFKHESYYATVNELTPVGTTIFTGFSGDNGATDIDDGPNGQIEYVIQYNP

DDPTSNDTFEIPLMLTGNIVLRKRLNYEDKTRYFVIIQANDRAQNLNERR

TTTTTLTVDVLDGDDLGPMFLPCVLVPNTRDCRPLTYQAAIPELRTPEEL

NPIIVTPPIQAIDQDRNIQPPSDRPGILYSILVGTPEDYPRFFHMHPRTA

ELSLLEPVNRDFHQKFDLVIKAEQDNGHPLPAFAGLHIEILDENNQSPYF

TMPSYQGYILESAPVGATISDSLNLTSPLRIVALDKDIEDVPPSGVPTKD

PELHLFLNDYTSVFTVTQTGITRYLTLLQPVDREEQQTYTFSITAFDGVQ

ESEPVIVNIQVMDANDNTPTFPEISYDVYVYTDMRPGDSVIQLTAVDADE

GSNGEITYEILVGAQGDFIINKTTGLITIAPGVEMIVGRTYALTVQAADN

APPAERRNSICTVYIEVLPPNNQSPPRFPQLMYSLEISEAMRVGAVLLNL

QATDREGDSITYAIENGDPQRVFNLSETTGILTLGKALDRESTDRYILII

TASDGRPDGTSTATVNIVVTDVNDNAPVFDPYLPRNLSVVEEEANAFVGQ

VKATDPDAGINGQVHYSLGNFNNLFRITSNGSIYTAVKLNREVRDYYELV
```

-continued

```
VVATDGAVHPRHSTLTLAIKVLDIDDNSPVFTNSTYTVLVEENLPAGTTI

LQIEAKDVDLGANVSYRIRSPEVKHFFALHPFTGELSLLRSLDYEAFPDQ

EASITFLVEAFDIYGTMPPGIATVTVIVKDMNDYPPVFSKRIYKGMVAPD

AVKGTPITTVYAEDADPPGLPASRVRYRVDDVQFPYPASIFEVEEDSGRV

ITRVNLNEEPTTIFKLVVVAFDDGEPVMSSSATVKILVLHPGEIPRFTQE

EYRPPPVSELATKGTMVGVISAAAINQSIVYSIVSGNEEDTFGINNITGV

IYVNGPLDYETRTSYVLRVQADSLEVVLANLRVPSKSNTAKVYIEIQDEN

NHPPVFQKKFYIGGVSEDARMFTSVLRVKATDKDTGNYSVMAYRLIIPPI

KEGKEGFVVETYTGLIKTAMLFHNMRRSYFKFQVIATDDYGKGLSGKADV

LVSVVNQLDMQVIVSNVPPTLVEKKIEDLTEILDRYVQEQIPGAKVVVES

IGARRHGDAFSLEDYTKCDLTVYAIDPQTNRAIDRNELFKFLDGKLLDIN

KDFQPYYGEGGRILEIRTPEAVTSIKKRGESLGYTEGALLALAFIIILCC

IPAILVVLVSYRQFKVRQAECTKTARIQAALPAAKPAVPAPAPVAAPPPP

PPPPPGAHLYEELGDSSMHKYEMPQYGSRRRLLPPAGQEEYGEVVGEAEE

EYEEEEEEPKKIKKPKVEIREPSEEEEVVVTIEKPPAAEPTYTTWKRARI

FPMIFKKVRGLADKRGIVDLEGEEWQRRLEEEDKDYLKLTLDQEEATEST

VESEEESSSDYTEYSEEESEFSESETTEEESESETPSEEEESSTPESEES

ESTESEGEKARKNIVLARRRPMVEEVKEVKGRKEEPQEEQKEPKMEEEEH

SEEEESGPAPVEESTDPEAQDIPEEGSAESASVEGGVESEEEESESGSSSS

SSESQSGGPWGYQVPAYDRSKNANQKKSPGANSEGYNTAL
```

An exemplary nucleic acid sequence encoding full-length human PCDH15 (CD2 splice form, NM_001142769.3, includes coding and non-coding regions):

(SEQ ID NO: 56)

```
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT
```

-continued

```
CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAAGTCCATATTTTACAATGCCCAGTTATC

AAGGCTATATCCTGGAATCTGCCCCAGTGGGAGCAACCATTTCGGACAGTCTCAATTTGACTTC

ACCTTTAAGAATAGTAGCTCTGGACAAGGACATAGAAGATGTTCCACCCAGTGGAGTTCCTACA

AAAGACCCAGAGCTTCACCTTTTTCTGAATGACTACACCTCAGTCTTCACCGTCACACAGACTG

GTATTACTCGCTACCTCACCTTACTTCAACCAGTGGACAGGGAAGAACAGCAAACTTACACCTT

TTCGATAACAGCATTTGATGGTGTACAAGAAAGTGAGCCAGTCATCGTCAATATTCAAGTGATG

GATGCAAATGATAACACGCCAACCTTCCCTGAAATATCCTATGATGTGTATGTTTATACAGACA

TGAGACCTGGGGACAGTGTCATACAGCTCACTGCAGTCGACGCAGACGAAGGGTCAAATGGGGA

GATCACATATGAAATCCTTGTTGGGGCTCAGGGAGACTTCATCATCAATAAAACAACAGGGCTT

ATCACCATCGCTCCAGGGGTGGAAATGATAGTCGGGCGGACTTACGCACTCACGGTCCAAGCAG

CGGATAATGCTCCTCCTGCAGAGCGAAGGAACTCCATCTGCACTGTGTATATTGAAGTGCTTCC

ACCAAATAATCAAAGCCCTCCTCGCTTCCCACAGCTGATGTATAGCCTTGAAATTAGTGAAGCC

ATGAGGGTTGGTGCTGTTTTATTAAATCTACAGGCAACTGATCGAGAGGGAGACTCAATAACAT

ATGCCATTGAGAATGGAGATCCTCAGAGAGTTTTTAATCTTTCAGAAACCACGGGGATTCTAAC

CTTAGGGAAAGCACTGGACAGGGAAAGCACTGATCGCTACATTCTGATCATCACAGCTTCAGAT

GGCAGGCCAGATGGGACCTCAACTGCCACAGTAAACATAGTGGTGACAGATGTCAATGACAATG

CTCCAGTGTTTGATCCTTATCTGCCAAGAAATTTATCTGTGGTGGAAGAAGAAGCCAATGCCTT

TGTGGGTCAAGTAAAAGCAACAGACCCTGATGCTGGAATAAATGGTCAAGTGCACTACAGTTTG

GGTAACTTTAATAATCTTTTTCGTATCACATCCAATGGGAGCATTTACACAGCAGTGAAGCTTA

ACAGAGAAGTCAGGGACTACTATGAACTTGTTGTTGTGGCAACAGATGGAGCAGTACACCCTCG

TCATTCAACTCTAACCTTGGCCATCAAGGTTTTGGACATTGATGATAACAGTCCTGTGTTCACC

AATTCAACATACACTGTCCTTGTTGAAGAGAATTTGCCAGCTGGGACTACCATCCTTCAAATAG

AGGCCAAAGATGTCGACCTTGGAGCAAATGTGTCTTACCGGATAAGAAGCCCAGAAGTGAAGCA

CTTTTTTGCACTACATCCATTTACAGGAGAACTATCGCTTTTAAGGAGTTTAGATTATGAGGCA

TTTCCAGACCAAGAAGCAAGTATCACTTTTCTGGTAGAGGCCTTTGATATTTATGGAACAATGC

CACCTGGTATTGCTACTGTCACAGTGATTGTAAAGGATATGAATGATTATCCTCCTGTCTTTAG

TAAACGAATATACAAAGGGATGGTGGCTCCGGATGCAGTCAAGGGTACACCTATCACAACAGTT

TATGCTGAAGATGCAGACCCTCCTGGATTACCTGCAAGTCGTGTGAGGTATAGAGTAGATGATG

TACAGTTTCCTTACCCTGCCAGTATTTTTGAAGTGGAAGAAGATTCTGGAAGAGTAATAACACG

AGTCAATCTTAATGAAGAACCTACAACAATTTTTAAGTTGGTGGTGGTTGCTTTTGATGATGGG

GAGCCTGTGATGTCCAGCAGTGCCACAGTGAAGATTCTTGTCTTACATCCTGGTGAGATCCCAC

GCTTCACACAGGAGGAATATAGACCTCCTCCAGTAAGTGAACTTGCCACCAAAGGGACCATGGT

TGGTGTAATTTCTGCTGCTGCCATTAATCAAAGTATTGTGTACTCCATTGTTTCAGGAAATGAA
```

-continued

```
GAAGATACATTTGGAATTAATAACATCACAGGTGTTATCTATGTGAATGGACCTCTGGATTATG

AGACCAGGACAAGCTATGTACTTCGAGTCCAAGCTGATTCCCTGGAAGTGGTCCTTGCCAATCT

CCGAGTTCCTTCAAAAAGCAATACAGCTAAAGTATACATTGAGATTCAGGATGAAAATAATCAT

CCCCCAGTGTTTCAGAAAAAATTCTACATCGGAGGTGTATCTGAAGATGCAAGAATGTTTACTT

CTGTACTCAGAGTGAAGGCTACTGATAAAGATACTGGCAATTATAGTGTCATGGCCTACAGACT

CATAATACCACCAATTAAAGAGGGAAAAGAAGGATTTGTAGTGGAAACATATACAGGGCTTATC

AAAACTGCTATGCTCTTCCATAATATGAGGAGATCCTACTTCAAGTTTCAAGTTATTGCAACTG

ACGACTATGGGAAGGGACTGAGCGGCAAAGCCGATGTACTCGTCTCCGTGGTCAATCAGCTGGA

TATGCAAGTCATTGTTTCCAATGTGCCTCCTACTCTAGTGGAAAAAAAGATAGAAGATCTTACA

GAGATCTTGGATCGCTATGTTCAGGAACAAATTCCTGGTGCCAAGGTCGTAGTGGAGTCCATTG

GAGCTCGCCGGCATGGAGATGCCTTTTCCCTAGAAGATTACACCAAATGTGACTTGACTGTCTA

TGCAATTGACCCCCAAACCAACAGAGCCATCGATAGAAATGAGCTTTTTAAATTTTTGGATGGC

AAACTACTTGATATCAATAAAGACTTTCAGCCGTATTATGGGGAAGGAGGACGCATTCTGGAGA

TCCGGACTCCAGAGGCAGTGACCAGCATTAAAAAGAGAGGAGAAAGTCTAGGATACACAGAAGG

GGCCTTGTTGGCTCTGGCCTTCATCATCATCCTCTGCTGCATTCCTGCCATCTTGGTGGTTTTG

GTCAGCTACAGACAGTTTAAAGTACGTCAAGCTGAGTGTACAAAGACTGCACGAATTCAGGCCG

CATTACCCGCGGCTAAACCAGCAGTGCCGGCTCCTGCACCAGTGGCAGCGCCCCGCCGCCGCC

GCCGCCTCCGCCAGGTGCGCATCTCTATGAAGAACTTGGAGACAGCTCAATGCATAAGTATGAA

ATGCCTCAATATGGGAGTCGCCGTCGATTGTTACCACCAGCTGGACAGGAGGAATATGGTGAGG

TGGTTGGTGAAGCTGAGGAAGAATATGAGGAGGAAGAGGAAGAGCCAAAGAAAATTAAAAAACC

AAAGGTTGAAATTAGAGAGCCTAGTGAGGAGGAAGAAGTAGTTGTAACTATCGAAAAACCACCA

GCAGCTGAGCCTACATACACAACATGGAAGAGAGCCAGAATATTCCCCATGATTTTTAAGAAAG

TTAGAGGATTAGCTGATAAAAGAGGAATCGTTGACCTTGAGGGTGAAGAGTGGCAGAGACGCCT

TGAGGAAGAAGATAAAGATTATTTGAAACTCACTCTGGACCAAGAGGAAGCAACAGAAAGCACT

GTAGAATCAGAGGAGGAATCCTCCAGCGACTATACTGAATACAGTGAAGAAGAGTCTGAGTTCA

GTGAGTCTGAGACTACAGAAGAGGAATCTGAGTCAGAGACACCCTCTGAGGAGGAGGAGAGTTC

CACCCCTGAATCAGAAGAATCGGAATCCACAGAGTCAGAAGGAGAAAAAGCAAGGAAAAACATT

GTGCTTGCAAGAAGAAGGCCCATGGTTGAGGAGGTCAAGGAAGTCAAGGGTAGGAAAGAGGAGC

CACAAGAAGAACAAAAAGAACCTAAGATGGAAGAAGAAGAACACTCAGAAGAAGAAGAAAGTGG

ACCAGCCCCTGTGGAAGAAAGTACAGACCCTGAAGCTCAAGATATCCCTGAAGAGGGCAGTGCA

GAATCAGCTTCGGTGGAAGGAGGTGTGGAAAGTGAGGAGGAATCAGAATCAGGTAGTAGTAGCA

GTAGTAGCGAAAGTCAGTCTGGAGGTCCATGGGGCTATCAGGTACCAGCGTATGACAGAAGCAA

GAATGCAAACCAAAAGAAGTCGCCAGGAGCAAACTCTGAAGGTTACAACACAGCACTTTGAAAG

AGATCACAGTAGGTGGAAGTTTTGCTGTGATGAGTGCTCTCGTGTGCAGTGCCTTCTGTGTGTT

CTCCAAAGTGACACTTGAAAGGGAGGAAATTGATCAAGATTTTGATATGACTTATGATCAGAAG

CATGCCAGAAAAGTGAATATATATGTTGTCCAAATCCAT
```

An exemplary amino acid sequence for full-length human PCDH15 (CD3 splice form cytoplasmic domain; EC1, EC3, EC5, EC7, EC9, EC11 and transmembrane-cytoplasmic domain in boldface; signal peptide, EC2, EC4, EC6, EC8, EC10 and MAD12 in regular font):

(SEQ ID NO: 57)

MFRQFYLWTCLASGIILGSLFEICLGQYDDDWQYEDCKLARGGPPATIVA

IDEESRNGTILVDNMLIKGTAGGPDPTIELSLKDNVDYWVLMDPVKQMLF

LNSTGRVLDRDPPMNIHSIVVQVQCINKKVGTIIYHEVRIVVRDRNDNSP

TFKHESYYATVNELTPVGTTIFTGFSGDNGATDIDDGPNGQIEYVIQYNP

DDPTSNDTFEIPLMLTGNIVLRKRLNYEDKTRYFVIIQANDRAQNLNERR

TTTTTLTVDVLDGDDLGPMFLPCVLVPNTRDCRPLTYQAAIPELRTPEEL

NPIIVTPPIQAIDQDRNIQPPSDRPGILYSILVGTPEDYPRFFHMHPRTA

ELSLLEPVNRDFHQKFDLVIKAEQDNGHPLPAFAGLHIEILDENNQSPYF

TMPSYQGYILESAPVGATISDSLNLTSPLRIVALDKDIEDTKDPELHLFL

NDYTSVFTVTQTGITRYLTLLQPVDREEQQTYTFSITAFDGVQESEPVIV

NIQVMDANDNTPTFPEISYDVYVYTDMRPGDSVIQLTAVDADEGSNGEIT

YEILVGAQGDFIINKTTGLITIAPGVEMIVGRTYALTVQAADNAPPAERR

NSICTVYIEVLPPNNQSPPRFPQLMYSLEISEAMRVGAVLLNLQATDREG

DSITYAIENGDPQRVFNLSETTGILTLGKALDRESTDRYILIITASDGRP

DGTSTATVNIVVTDVNDNAPVFDPYLPRNLSVVEEEANAFVGQVKATDPD

AGINGQVHYSLGNFNNLFRITSNGSIYTAVKLNREVRDYYELVVVATDGA

-continued

VHPRHSTLTLAIKVLDIDDNSPVFTNSTYTVLVEENLPAGTTILQIEAKD

VDLGANVSYRIRSPEVKHFFALHPFTGELSLLRSLDYEAFPDQEASITFL

VEAFDIYGTMPPGIATVTVIVKDMNDYPPVFSKRIYKGMVAPDAVKGTPI

TTVYAEDADPPGLPASRVRYRVDDVQFPYPASIFEVEEDSGRVITRVNLN

EEPTTIFKLVVVAFDDGEPVMSSSATVKILVLHPGEIPRFTQEEYRPPPV

SELATKGTMVGVISAAAINQSIVYSIVSGNEEDTFGINNITGVIYVNGPL

DYETRTSYVLRVQADSLEVVLANLRVPSKSNTAKVYIEIQDENNHPPVFQ

KKFYIGGVSEDARMFTSVLRVKATDKDTGNYSVMAYRLIIPPIKEGKEGF

VVETYTGLIKTAMLFHNMRRSYFKFQVIATDDYGKGLSGKADVLVSVVNQ

LDMQVIVSNVPPTLVEKKIEDLTEILDRYVQEQIPGAKVVVESIGARRHG

DAFSLEDYTKCDLTVYAIDPQTNRAIDRNELFKFLDGKLLDINKDFQPYY

GEGGRILEIRTPEAVTSIKKRGESLGYTEGALLALAFIIILCCIPAILVV

LVSYRQFKVRQAECTKTARIQAALPAAKPAVPAPAPVAAPPPPPPPPPGA

HLYEELGDSSMHKYEMPQYGSRRRLLPPAGQEEYGEVVGEAEEEYEEEEW

ARKRMIKLVVDREYETSSTGEDSAPECQRNRLHHPSIHSNINGNIYIAQN

GSVVRTRRACLTDNLKVASPVRLGGPFKKLDKLAVTHEENVPLNTLSKGP

FSTEKMNARPTLVTFAPCPVGTDNTAVKPLRNRLKSTVEQESMIDSKNIK

EALEFHSDHTQSDDEELWMGPWNNLHIPMTKL

An exemplary nucleic acid sequence encoding full-length human PCDH15 (CD3 splice form, NM_001142771.2, includes coding and non-coding regions):

(SEQ ID NO: 58)

ATGTTTCGACAGTTTTATCTCTGGACATGTTTAGCTTCAGGGATCATCCTGGGCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTGGTTATTAAGGCTGAACAAGACAATGGTCATCCTCTTCCTGCCTTTGCC

GGTCTACACATTGAAATACTGGATGAAAACAATCAAAGTCCATATTTTACAATGCCCAGTTATC

-continued

```
AAGGCTATATCCTGGAATCTGCCCCAGTGGGAGCAACCATTTCGGACAGTCTCAATTTGACTTC

ACCTTTAAGAATAGTAGCTCTGGACAAGGACATAGAAGATACAAAAGACCCAGAGCTTCACCTT

TTTCTGAATGACTACACCTCAGTCTTCACCGTCACACAGACTGGTATTACTCGCTACCTCACCT

TACTTCAACCAGTGGACAGGGAAGAACAGCAAACTTACACCTTTTCGATAACAGCATTTGATGG

TGTACAAGAAAGTGAGCCAGTCATCGTCAATATTCAAGTGATGGATGCAAATGATAACACGCCA

ACCTTCCCTGAAATATCCTATGATGTGTATGTTTATACAGACATGAGACCTGGGGACAGTGTCA

TACAGCTCACTGCAGTCGACGCAGACGAAGGGTCAAATGGGGAGATCACATATGAAATCCTTGT

TGGGGCTCAGGGAGACTTCATCATCAATAAAACAACAGGGCTTATCACCATCGCTCCAGGGGTG

GAAATGATAGTCGGGCGGACTTACGCACTCACGGTCCAAGCAGCGGATAATGCTCCTCCTGCAG

AGCGAAGGAACTCCATCTGCACTGTGTATATTGAAGTGCTTCCACCAAATAATCAAAGCCCTCC

TCGCTTCCCACAGCTGATGTATAGCCTTGAAATTAGTGAAGCCATGAGGGTTGGTGCTGTTTTA

TTAAATCTACAGGCAACTGATCGAGAGGGAGACTCAATAACATATGCCATTGAGAATGGAGATC

CTCAGAGAGTTTTTAATCTTTCAGAAACCACGGGGATTCTAACCTTAGGGAAAGCACTGGACAG

GGAAAGCACTGATCGCTACATTCTGATCATCACAGCTTCAGATGGCAGGCCAGATGGGACCTCA

ACTGCCACAGTAAACATAGTGGTGACAGATGTCAATGACAATGCTCCAGTGTTTGATCCTTATC

TGCCAAGAAATTTATCTGTGGTGGAAGAAGAAGCCAATGCCTTTGTGGGTCAAGTAAAAGCAAC

AGACCCTGATGCTGGAATAAATGGTCAAGTGCACTACAGTTTGGGTAACTTTAATAATCTTTTT

CGTATCACATCCAATGGGAGCATTTACACAGCAGTGAAGCTTAACAGAGAAGTCAGGGACTACT

ATGAACTTGTTGTTGTGGCAACAGATGGAGCAGTACACCCTCGTCATTCAACTCTAACCTTGGC

CATCAAGGTTTTGGACATTGATGATAACAGTCCTGTGTTCACCAATTCAACATACACTGTCCTT

GTTGAAGAGAATTTGCCAGCTGGGACTACCATCCTTCAAATAGAGGCCAAAGATGTCGACCTTG

GAGCAAATGTGTCTTACCGGATAAGAAGCCCAGAAGTGAAGCACTTTTTTGCACTACATCCATT

TACAGGAGAACTATCGCTTTTAAGGAGTTTAGATTATGAGGCATTTCCAGACCAAGAAGCAAGT

ATCACTTTTCTGGTAGAGGCCTTTGATATTTATGGAACAATGCCACCTGGTATTGCTACTGTCA

CAGTGATTGTAAAGGATATGAATGATTATCCTCCTGTCTTTAGTAAACGAATATACAAAGGGAT

GGTGGCTCCGGATGCAGTCAAGGGTACACCTATCACAACAGTTTATGCTGAAGATGCAGACCCT

CCTGGATTACCTGCAAGTCGTGTGAGGTATAGAGTAGATGATGTACAGTTTCCTTACCCTGCCA

GTATTTTTGAAGTGGAAGAAGATTCTGGAAGAGTAATAACACGAGTCAATCTTAATGAAGAACC

TACAACAATTTTTAAGTTGGTGGTGGTTGCTTTTGATGATGGGGAGCCTGTGATGTCCAGCAGT

GCCACAGTGAAGATTCTTGTCTTACATCCTGGTGAGATCCCACGCTTCACACAGGAGGAATATA

GACCTCCTCCAGTAAGTGAACTTGCCACCAAAGGGACCATGGTTGGTGTAATTTCTGCTGCTGC

CATTAATCAAAGTATTGTGTACTCCATTGTTTCAGGAAATGAAGAAGATACATTTGGAATTAAT

AACATCACAGGTGTTATCTATGTGAATGGACCTCTGGATTATGAGACCAGGACAAGCTATGTAC

TTCGAGTCCAAGCTGATTCCCTGGAAGTGGTCCTTGCCAATCTCCGAGTTCCTTCAAAAAGCAA

TACAGCTAAAGTATACATTGAGATTCAGGATGAAAATAATCATCCCCCAGTGTTTCAGAAAAAA

TTCTACATCGGAGGTGTATCTGAAGATGCAAGAATGTTTACTTCTGTACTCAGAGTGAAGGCTA

CTGATAAAGATACTGGCAATTATAGTGTCATGGCCTACAGACTCATAATACCACCAATTAAAGA

GGGAAAAGAAGGATTTGTAGTGGAAACATATACAGGGCTTATCAAAACTGCTATGCTCTTCCAT

AATATGAGGAGATCCTACTTCAAGTTTCAAGTTATTGCAACTGACGACTATGGGAAGGGACTGA

GCGGCAAAGCCGATGTACTCGTCTCCGTGGTCAATCAGCTGGATATGCAAGTCATTGTTTCCAA
```

-continued

```
TGTGCCTCCTACTCTAGTGGAAAAAAAGATAGAAGATCTTACAGAGATCTTGGATCGCTATGTT

CAGGAACAAATTCCTGGTGCCAAGGTCGTAGTGGAGTCCATTGGAGCTCGCCGGCATGGAGATG

CCTTTTCCCTAGAAGATTACACCAAATGTGACTTGACTGTCTATGCAATTGACCCCCAAACCAA

CAGAGCCATCGATAGAAATGAGCTTTTTAAATTTTTGGATGGCAAACTACTTGATATCAATAAA

GACTTTCAGCCGTATTATGGGGAAGGAGGACGCATTCTGGAGATCCGGACTCCAGAGGCAGTGA

CCAGCATTAAAAAGAGAGGAGAAAGTCTAGGATACACAGAAGGGGCCTTGTTGGCTCTGGCCTT

CATCATCATCCTCTGCTGCATTCCTGCCATCTTGGTGGTTTTGGTCAGCTACAGACAGTTTAAA

GTACGTCAAGCTGAGTGTACAAAGACTGCACGAATTCAGGCCGCATTACCCGCGGCTAAACCAG

CAGTGCCGGCTCCTGCACCAGTGGCAGCGCCCCCGCCGCCGCCGCCGCCTCCGCCAGGTGCGCA

TCTCTATGAAGAACTTGGAGACAGCTCAATGCATAAGTATGAAATGCCTCAATATGGGAGTCGC

CGTCGATTGTTACCACCAGCTGGACAGGAGGAATATGGTGAGGTGGTTGGTGAAGCTGAGGAAG

AATATGAGGAGGAAGAGTGGGCAAGAAAAAGAATGATCAAGTTAGTTGTTGATCGAGAGTATGA

AACCAGCTCAACTGGAGAAGACAGTGCTCCTGAATGTCAGAGAAACCGTCTTCACCATCCTAGT

ATCCACAGTAATATCAACGGCAATATATATATTGCACAGAATGGTTCTGTGGTGAGAACCCGCC

GTGCCTGCCTCACGGACAACTTAAAAGTTGCTTCCCCTGTTCGACTGGGAGGGCCCTTTAAGAA

ACTAGACAAGTTGGCAGTGACACATGAGGAGAATGTACCTCTGAACACATTATCAAAGGGGCCA

TTTTCTACTGAAAAAATGAATGCAAGACCAACTCTGGTTACATTTGCCCCTTGCCCTGTGGGGA

CTGACAATACAGCGGTGAAGCCACTAAGGAACAGGCTGAAAAGCACAGTTGAACAGGAGTCCAT

GATTGACAGTAAGAACATCAAGGAGGCTTTGGAATTTCATAGTGACCACACACAGTCTGATGAT

GAAGAGCTTTGGATGGGCCCCTGGAACAACCTCCATATACCAATGACAAAACTGTGACCAATTT

TTTAAAAGATATTTTAATTAATTTTTACTTACATTTTTAATAAACTGTGCTTTTTATTGTCACT

GAGAAAACAATGTATGGAATTTATATCATGCACACAAGCTAAAACTTTGAACAATATGCTTTAA

AATTTTAAGAGACAGATTTGCACTCACATTGTTATCAATTAATCGTTTTTCCCAGAAAATCCTT

TTGGACATACTTTCACTAAATAACCTATCGTTTAAACATTTAGCTGTTTTGTTGGGTCTTGAAT

TTTTGTTCATTTTAATAAACAAGAAATAATTACTAAATAATCATTTATATTTTATTGATTAACA

TAGATTATGCTTTATTTCTAGCTCCACAAAACATTTTTAGTACATGTAATTTTATTTTCCATAG

CCAAAAGGGCAAAAAAGAAGTAAGAGGATATTTACAGGCAATGAGTTTATACAGCTGCTGTCTA

TACTGCCCTAATTTTTAAAATGAAAGCTAGAATTGCAAAGTAAAGTAAATGAGGGAATCACCTG

TAAATAATTAATTATTTTAAATCATGAGCTTGTTTTCTTTCTTTATTGTCCTGTATAAAGGTTT

TCACATTTTACCATAAATACATTTATATCTTGACCCTTTAGGAAACCACTTGAAGTCGTATGTC

TTTTTATCAATATTATTTACAATATTCTCTTGTCCCTTCATCTCATATCAAATATGGTAGATAC

TTTAGTTTAGTTTAATCACTTGAGGTTAAATAATTGTTTGGAGCAACATGGAAATCTCACCCTT

AGCAAAAGCTTTTAGGGAAGTGAGAAAGGTTCGAGTAAGCAGTAATGCATCTAGAACGACAATT

TCATAATGGAAGACATGGTGAGGTTAGGGAAGTCTCACATTAATGTCACTAGACTTTAATAGTT

TGTAAACCCAGCATATCAGAGTAAAGGAATTTGGCAGGGTTGAAATGTATATAATATATAAAGC

TTATAAAGGCTATGAATTCATAACTTCAAATGTTGTGTTTAACTTCTTCCATTTTCAGGTTATT

TATAGAATATTTTAATGCACATATTTATGTGCCTAAAATCCAGAACCAGGAAATCATTGCCTGG

GCATTTTTTAAAATCAAAGAACATGGTCTTGATTTTTTACCATTGAACAAAGCACAGTGTTTCA

TCATAAGTAGAAATGAAAACAGAATATCCTTTAAAAAACTTGCCTTGTGTGTTGCTTATTTTCC

AGATGATGTAAAAAGAATGAAACAATATAGATTAAGAGAATTCAGAATTCTATTGAATATTACT

TAGTATGATATAGATGTAGCTCACTTCAAATTTTGCACAGTATTGACCAAGTTCAGGTTTTAAT
```

-continued

```
GAAATTTCCTCATGCATGCTTAATATATGGTTGAAGGACTGAATAATGCACTATTATTTATTCC

CCTCTTACATGTTTCGCGTCTTAAAAATTGTTTATTATTATGCTATTTCCTCATTTCCAAAGTG

AATGAATTGTACTGACATAAACTTGCCGACTTGTAAGAGTAGTATGTTTTTACTTCAGATTTCC

AAGAAAATATTTGAGATCAAATACAGTAACATCTCATCTACCTTATTTTATTGAGAATTAATGC

ATTCCATACCCTTGCCAAAAAAACAAAACAAAACAAACAAACAAAAAAAAACCTAGTGGCATTA

GCTAGATTAGAAACGTAGAATCATGACCACACCTCCTGGCCTGCCAAACAAGCATCCACATTTT

CAAAAGATCCTAAGGTGGTTTATATGCACATTAAATTTTGGAAGCAATGAAGTCCGGGGCTTAT

TCCTTCAGGCACCAAAGCAATGGTTTTTAGTATAGGATACTTTGTATAGGAATTAGATTAAGCA

TATATTTCCCTACTAATTCAATCAGAGGTCATCGAATATAATTTAATATTATCTTGATACCCCC

AGATCATCTCAGTCAGCATCCCTTGATATTCTCTCTATATACAGCTTCATGGCTGCGTTTTTGT

CCTTTGATTTCTGGCTGTGACATTTAACTTATTCTGTTGTTGTGCCTTTCTCACATTTTTTTCT

TTCAGTTTATAGCTTCTAGTATCCTGATGGGAAAGTTTGTGTTTTTTGTTTGTTTTCTTAATGT

TGAAAAATCATGAAGCTTAAGATGGGAATTAGGTACACGGATTCAACCAAATGTTTTGCGACTC

TTAGACGCTTTCTTTGGTTACCAGTAGATTTGGAAATATGATGTTGGCAGAAGTCTAGTGGCCT

GACATATGAGATGTCACTGTATTTTAAACTACATTTTTTATGAGAAAATATGCAAAATTTTACA

AGCCACTTAGCAGACACATTTCAGTAATTTAAACTTGATCATTTCAGTAAAAACAATCATGAGG

TCAATCATCTGTTACTTAATGGAGATAGTATAAAGAGAAGCAGAATTTACACAGAGCAACCAAA

CCAAATATTTGGTCAGTATATTTTTGGGTAACGTAGAGCAGCAAAATTATTACTAACTAAATAA

ATCTGGATCAATTAAATAGTTACTTTCATAGAACTTTCACTAGTCTATAAATCCCTGACTCAGG

ATTAAAACTGTGGAACCCAGAGGAAATACCCAGGTATGTTTAATCTTAAGAATACTTCATATAA

ATAACGTTTCAATGTAAATATTTATAAAGAAATTGGTTGTTATTTTTCCTAGGAAGGTGTAGGA

AGGTTTTCTTGTTGTTCTCAATCAGCACTAGCTTCAATCAGGCAGAAGAAACAGCAGGTCTTGG

CTAATCGAGGTGAGAACAGAATGATGTAATGACTAATATTGCAACCCGTTGATTTTAGAAGGTC

TTGTGGGCATTAAGGGAAAGCAGAGGAAGAATGAGAAAATATGGTCAGAGTGACATAGGACATT

TGTGACTTAATGACCATCGAATCACAGGTGTTAATCTCCCTCTCTCAATTTGTCTTTCTCATTA

ATTACAGACTCTGAGAGTTGTCATAGAATTGCAACCGTAGGTTGGCCAAAACCATCTTTTTAAA

ATACAGAAGAAAGTTTGCCTTGAATTTTATATGTGATATGTCATTCATGTTATTTTACCACATT

GTTCACAGGGATGTTAAAGACTATTATTTACTTAAGTGGTTGTTCCAAAGGTGATTCAGTAGTT

ACCATTAAAATATTATTTAAAAACATTTTTATATCATAGAGCCAGAAGTAATTGAATATTGACT

CTCGAGGGAAGACATTTTCTGTCTTTTATTTCATGAGCTTTGATTTTTCTCTTTCTCTGCTTCA

CCTTCTGCACTTTATACCTTAAGTGGGATTTATATACCACTTGAATTTAATTAGCAAAATAGGC

AAAAAGTGCTAATAATCTATTCTCAGGGCAGATGCCTATTGGTGCCTGCAAATTACACAGCGAT

AAGGCTGAAGGATAGGTTCAAAATAATGTTGAGGACTTACACATTTTATAGATAGTTTCTTTCT

ATTCCCAAATGGTATGTGAAATTTTTGTTCTATTTTTTTTATTGGTTTTCAATAGTTAATTTTG

ATCTTTATCATAAGAAGCTTTAGTTATAGACTGGTATTTTTTTCATTGCAATCTACTTTAAATT

TATGGTCAGTTAAGCACATGTATGGAAGATTCGAACATTGTCTATAGTTTGAAAAATCTATCAA

CACCTTCACTGCTTTCCCAATTTCTTTATCCAAATACCTGTTCTTCCTTAACAAATATTATGTT

ACTGTATAAGAATCTGAATTAGAAGTTTTAAGTTAAAATGCATTGTTATTCACTACACAATGTT

TCAAAAATAAATTTTCATTTGAAAA
```

The present disclosure, at least in part, is related to designing a mini-PCDH15 coding sequence that is small enough to fit into an AAV genome. PCDH15 binds to CDH23 at its N-terminal and to TMC1 and LHFPL5 near its C terminal. The intervening EC domains may not be essential for its function. A mini-PCDH15, as used herein, refers to a PCDH15 protein with one or more deletions of non-essential domains (e.g., intervening EC domains) that retains normal PCDH15 function (e.g., binding to CDH12). Exemplary human PCDH15 signal peptides, each of EC domains (EC1-EC11), MAD12 and transmembrane-cytoplasmic domain amino acid sequences and nucleic acid sequences encoding each of the domains are set forth in SEQ ID NOs: 3-30 and SEQ ID NO: 59-62, 119 and 120.

```
Signaling peptide sequence
                                            (SEQ ID NO: 3)
MFRQFYLWTCLASGIILGSLFEICLG EC1 amino acid sequence
                                            (SEQ ID NO: 4)
QYDDDWQYEDCKLARGGPPATIVAIDEESRNGTILVDNMLIKGTAGGPDPTIELSLKDNVDYWV

LMDPVKQMLFLNSTGRVLDRDPPMNIHSIVVQVQCINKKVGTIIYHEVRIVVRDRNDN

EC2 amino acid sequence
                                            (SEQ ID NO: 5)
SPTFKHESYYATVNELTPVGTTIFTGFSGDNGATDIDDGPNGQIEYVIQYNPDDPTSNDTFEIP

LMLTGNIVLRKRLNYEDKTRYFVIIQANDRAQNLNERRTTTTTLTVDVLDGDDL

EC3 amino acid sequence
                                            (SEQ ID NO: 6)
GPMFLPCVLVPNTRDCRPLTYQAAIPELRTPEELNPIIVTPPIQAIDQDRNIQPPSDRPGILYS

ILVGTPEDYPRFFHMHPRTAELSLLEPVNRDFHQKFDLVIKAEQDNGHPLPAFAGLHIEILDEN

NQ

EC4 amino acid sequence
                                            (SEQ ID NO: 7)
SPYFTMPSYQGYILESAPVGATISDSLNLTSPLRIVALDKDIEDTKDPELHLFLNDYTSVFTVT

QTGITRYLTLLQPVDREEQQTYTFSITAFDGVQESEPVIVNIQVMDANDN

EC4 CD2 splicing variant amino acid sequence
                                            (SEQ ID NO: 119)
SPYFTMPSYQGYILESAPVGATISDSLNLTSPLRIVALDKDIEDVPPSGVPTKDPELHLFLNDY

TSVFTVTQTGITRYLTLLQPVDREEQQTYTFSITAFDGVQESEPVIVNIQVMDANDN

EC5 amino acid sequence
                                            (SEQ ID NO: 8)
TPTFPEISYDVYVYTDMRPGDSVIQLTAVDADEGSNGEITYEILVGAQGDFIINKTTGLITIAP

GVEMIVGRTYALTVQAADNAPPAERRNSICTVYIEVLPPNNQ

EC6 amino acid sequence
                                            (SEQ ID NO: 9)
SPPRFPQLMYSLEISEAMRVGAVLLNLQATDREGDSITYAIENGDPQRVFNLSETTGILTLGKA

LDRESTDRYILIITASDGRPDGTSTATVNIVVTDVNDN

EC7 amino acid sequence
                                            (SEQ ID NO: 10)
APVFDPYLPRNLSVVEEEANAFVGQVKATDPDAGINGQVHYSLGNFNNLFRITSNGSIYTAVKL

NREVRDYYELVVVATDGAVHPRHSTLTLAIKVLDIDDN

EC8 amino acid sequence
                                            (SEQ ID NO: 11)
SPVFTNSTYTVLVEENLPAGTTILQIEAKDVDLGANVSYRIRSPEVKHFFALHPFTGELSLLRS

LDYEAFPDQEASITFLVEAFDIYGTMPPGIATVTVIVKDMNDY

EC9 amino acid sequence
                                            (SEQ ID NO: 12)
PPVFSKRIYKGMVAPDAVKGTPITTVYAEDADPPGLPASRVRYRVDDVQFPYPASIFEVEEDSG

RVITRVNLNEEPTTIFKLVVVAFDDGEPVMSSSATVKILVLHPGE

EC10 amino acid sequence
                                            (SEQ ID NO: 13)
IPRFTQEEYRPPPVSELATKGTMVGVISAAAINQSIVYSIVSGNEEDTFGINNITGVIYVNGPL

DYETRTSYVLRVQADSLEVVLANLRVPSKSNTAKVYIEIQDENNH
```

-continued

EC11 amino acid sequence (SEQ ID NO: 14)

PPVFQKKFYIGGVSEDARMFTSVLRVKATDKDTGNYSVMAYRLIIPPIKEGKEGFVVETYTGLI

KTAMLFHNMRRSYFKFQVIATDDYGKGLSGKADVLVSVVNQLD

MAD12 amino acid sequence (SEQ ID NO: 15)

MQVIVSNVPPTLVEKKIEDLTEILDRYVQEQIPGAKVVVESIGARRHGDAFSLEDYTKCDLTVY

AIDPQTNRAIDRNELFKFLDGKLLDINKDFQPYYGEGGRILEIRTPEAVTSIKKRGESLGYTE

Transmembrane-cytoplasmic domain amino acid sequence (CD1 isoform)

(SEQ ID NO: 16)

GALLALAFIIILCCIPAILVVLVSYRQFKVRQAECTKTARIQAALPAAKPAVPAPAPVAAPPPP

PPPPPGAHLYEELGDSSMHNLFLLYHFQQSRGNNSVSEDRKHQQVVMPFSSNTIEAHKSAHVDG

SLKSNKLKSARKFTFLSDEDDLSAHNPLYKENISQVSTNSDISQRTDFVDPFSPKIQAKSKSLR

GPREKIQRLWSQSVSLPRRLMRKVPNRPEIIDLQQWQGTRQKAENENTGICTNKRGSSNPLLTT

EEANLTEKEEIRQGETLMIEGTEQLKSLSSDSSFCFPRPHFSFSTLPTVSRTVELKSEPNVISS

PAECSLELSPSRPCVLHSSLSRRETPICMLPIETERNIFENFAHPPNISPSACPLPPPPPISPP

SPPPAPAPLAPPPDISPFSLFCPPPSPPSIPLPLPPPTFFPLSVSTSGPPTPPLLPPFPTPLPP

PPPSIPCPPPPSASFLSTECVCITGVKCTTNLMPAEKIKSSMTQLSTTTVCKTDPQREPKGILR

HVKNLAELEKSVANMYSQIEKNYLRTNVSELQTMCPSEVTNMEITSEQNKGSLNNIVEGTEKQS

HSQSTSL

Transmembrane-cytoplasmic domain amino acid sequence (CD2 isoform)

(SEQ ID NO: 59)

GALLALAFIIILCCIPAILVVLVSYRQFKVRQAECTKTARIQAALPAAKPAVPAPAPVAAPPPP

PPPPPGAHLYEELGDSSMHKYEMPQYGSRRRLLPPAGQEEYGEVVGEAEEEYEEEEEEPKKIKK

PKVEIREPSEEEEVVVTIEKPPAAEPTYTTWKRARIFPMIFKKVRGLADKRGIVDLEGEEWQRR

LEEEDKDYLKLTLDQEEATESTVESEEESSSDYTEYSEEESEFSESETTEEESESETPSEEEES

STPESEEESESTESEGEKARKNIVLARRRPMVEEVKEVKGRKEEPQEEQKEPKMEEEEHSEEEES

GPAPVEESTDPEAQDIPEEGSAESASVEGGVESEEESESGSSSSSSESQSGGPWGYQVPAYDRS

KNANQKKSPGANSEGYNTAL

Transmembrane-cytoplasmic domain amino acid sequence (CD3 isoform)

(SEQ ID NO: 60)

GALLALAFIIILCCIPAILVVLVSYRQFKVRQAECTKTARIQAALPAAKPAVPAPAPVAAPPPP

PPPPPGAHLYEELGDSSMHKYEMPQYGSRRRLLPPAGQEEYGEVVGEAEEEYEEEEWARKRMIK

LVVDREYETSSTGEDSAPECQRNRLHHPSIHSNINGNIYIAQNGSVVRTRRACLTDNLKVASPV

RLGGPFKKLDKLAVTHEENVPLNTLSKGPFSTEKMNARPTLVTFAPCPVGTDNTAVKPLRNRLK

STVEQESMIDSKNIKEALEFHSDHTQSDDEELWMGPWNNLHIPMTKL

Signaling peptide coding sequence (SEQ ID NO: 17)

ATGTTTCGACAGTTTTATCTCTGGACATGTTTAGCTTCAGGGATCATCCTGGGCTCTCTCTTTG

AAATCTGCTTGGGC

EC1 coding sequence (SEQ ID NO: 18)

CAGTATGATGATGACTGGCAATATGAGGATTGCAAACTAGCTAGGGGAGGACCACCAGCTACCA

TAGTTGCTATTGATGAAGAAAGTCGGAATGGTACAATTCTGGTGGACAACATGCTGATCAAAGG

GACTGCTGGAGGACCAGACCCCACCATAGAACTTTCTTTAAAGGATAATGTGGATTACTGGGTG

TTGATGGATCCTGTTAAGCAAATGCTTTTCCTGAACAGCACCGGAAGAGTTCTGGATAGAGATC

CACCGATGAACATACACTCCATTGTGGTGCAGGTCCAGTGCATCAACAAAAAAGTGGGCACTAT

TATCTACCATGAAGTGCGAATAGTGGTGAGAGACAGGAATGACAAC

-continued

EC2 coding sequence
(SEQ ID NO: 19)
TCACCCACTTTCAAGCATGAAAGCTACTATGCCACAGTGAATGAGCTCACTCCAGTTGGTACCA

CAATATTCACAGGATTTTCAGGAGACAATGGAGCTACAGATATAGATGATGGACCAAATGGACA

GATAGAGTATGTTATTCAGTATAATCCAGATGATCCGACATCCAATGACACCTTTGAAATTCCC

CTAATGTTGACTGGAAATATAGTGTTAAGGAAGAGGCTCAACTATGAAGATAAGACTCGCTACT

TTGTCATAATCCAAGCTAATGACCGTGCCCAAAATCTGAATGAGAGGCGAACCACCACCACCAC

TCTCACAGTGGATGTTCTGGATGGAGATGACTTG

EC3 coding sequence
(SEQ ID NO: 20)
GGTCCAATGTTTCTTCCTTGTGTCCTTGTGCCAAACACTCGTGATTGCCGTCCACTCACTTATC

AAGCTGCCATACCTGAGTTGAGAACTCCGGAAGAACTGAACCCCATTATTGTTACGCCACCAAT

CCAAGCCATTGATCAGGACCGGAATATTCAACCGCCATCAGATAGGCCAGGAATCCTCTATTCC

ATCCTTGTTGGGACTCCTGAGGATTACCCACGATTTTTCCATATGCATCCTAGGACAGCAGAAC

TTAGTCTCCTGGAGCCAGTAAACAGAGACTTTCACCAGAAATTTGATTTGGTTATTAAGGCTGA

ACAAGACAATGGTCATCCTCTTCCTGCCTTTGCCGGTCTACACATTGAAATACTGGATGAAAAC

AATCAA

EC4 coding sequence
(SEQ ID NO: 21)
AGTCCATATTTTACAATGCCCAGTTATCAAGGCTATATCCTGGAATCTGCCCCAGTGGGAGCAA

CCATTTCGGACAGTCTCAATTTGACTTCACCTTTAAGAATAGTAGCTCTGGACAAGGACATAGA

AGATACAAAAGACCCAGAGCTTCACCTTTTTCTGAATGACTACACCTCAGTCTTCACCGTCACA

CAGACTGGTATTACTCGCTACCTCACCTTACTTCAACCAGTGGACAGGGAAGAACAGCAAACTT

ACACCTTTTCGATAACAGCATTTGATGGTGTACAAGAAAGTGAGCCAGTCATCGTCAATATTCA

AGTGATGGATGCAAATGATAAC

EC4 CD2 splice form coding sequence:
(SEQ ID NO: 120)
AGTCCATATTTTACAATGCCCAGTTATCAAGGCTATATCCTGGAATCTGCCCCAGTGGGAGCAA

CCATTTCGGACAGTCTCAATTTGACTTCACCTTTAAGAATAGTAGCTCTGGACAAGGACATAGA

AGATGTTCCACCCAGTGGAGTTCCTACAAAAGACCCAGAGCTTCACCTTTTTCTGAATGACTAC

ACCTCAGTCTTCACCGTCACACAGACTGGTATTACTCGCTACCTCACCTTACTTCAACCAGTGG

ACAGGGAAGAACAGCAAACTTACACCTTTTCGATAACAGCATTTGATGGTGTACAAGAAAGTGA

GCCAGTCATCGTCAATATTCAAGTGATGGATGCAAATGATAAC

EC5 coding sequence
(SEQ ID NO: 22)
ACGCCAACCTTCCCTGAAATATCCTATGATGTGTATGTTTATACAGACATGAGACCTGGGGACA

GTGTCATACAGCTCACTGCAGTCGACGCAGACGAAGGGTCAAATGGGGAGATCACATATGAAAT

CCTTGTTGGGGCTCAGGGAGACTTCATCATCAATAAAACAACAGGGCTTATCACCATCGCTCCA

GGGGTGGAAATGATAGTCGGGCGGACTTACGCACTCACGGTCCAAGCAGCGGATAATGCTCCTC

CTGCAGAGCGAAGGAACTCCATCTGCACTGTGTATATTGAAGTGCTTCCACCAAATAATCAA

EC6 coding sequence
(SEQ ID NO: 23)
AGCCCTCCTCGCTTCCCACAGCTGATGTATAGCCTTGAAATTAGTGAAGCCATGAGGGTTGGTG

CTGTTTTATTAAATCTACAGGCAACTGATCGAGAGGGAGACTCAATAACATATGCCATTGAGAA

-continued

TGGAGATCCTCAGAGAGTTTTTAATCTTTCAGAAACCACGGGGATTCTAACCTTAGGGAAAGCA

CTGGACAGGGAAAGCACTGATCGCTACATTCTGATCATCACAGCTTCAGATGGCAGGCCAGATG

GGACCTCAACTGCCACAGTAAACATAGTGGTGACAGATGTCAATGACAAT

EC7 coding sequence (SEQ ID NO: 24)

GCTCCAGTGTTTGATCCTTATCTGCCAAGAAATTTATCTGTGGTGGAAGAAGAAGCCAATGCCT

TTGTGGGTCAAGTAAAAGCAACAGACCCTGATGCTGGAATAAATGGTCAAGTGCACTACAGTTT

GGGTAACTTTAATAATCTTTTTCGTATCACATCCAATGGGAGCATTTACACAGCAGTGAAGCTT

AACAGAGAAGTCAGGGACTACTATGAACTTGTTGTTGTGGCAACAGATGGAGCAGTACACCCTC

GTCATTCAACTCTAACCTTGGCCATCAAGGTTTTGGACATTGATGATAAC

EC8 coding sequence (SEQ ID NO: 25)

AGTCCTGTGTTCACCAATTCAACATACACTGTCCTTGTTGAAGAGAATTTGCCAGCTGGGACTA

CCATCCTTCAAATAGAGGCCAAAGATGTCGACCTTGGAGCAAATGTGTCTTACCGGATAAGAAG

CCCAGAAGTGAAGCACTTTTTTGCACTACATCCATTTACAGGAGAACTATCGCTTTTAAGGAGT

TTAGATTATGAGGCATTTCCAGACCAAGAAGCAAGTATCACTTTTCTGGTAGAGGCCTTTGATA

TTTATGGAACAATGCCACCTGGTATTGCTACTGTCACAGTGATTGTAAAGGATATGAATGATTA

T

EC9 coding sequence (SEQ ID NO: 26)

CCTCCTGTCTTTAGTAAACGAATATACAAAGGGATGGTGGCTCCGGATGCAGTCAAGGGTACAC

CTATCACAACAGTTTATGCTGAAGATGCAGACCCTCCTGGATTACCTGCAAGTCGTGTGAGGTA

TAGAGTAGATGATGTACAGTTTCCTTACCCTGCCAGTATTTTTGAAGTGGAAGAAGATTCTGGA

AGAGTAATAACACGAGTCAATCTTAATGAAGAACCTACAACAATTTTTAAGTTGGTGGTGGTTG

CTTTTGATGATGGGGAGCCTGTGATGTCCAGCAGTGCCACAGTGAAGATTCTTGTCTTACATCC

TGGTGAG

EC10 coding sequence (SEQ ID NO: 27)

ATCCCACGCTTCACACAGGAGGAATATAGACCTCCTCCAGTAAGTGAACTTGCCACCAAAGGGA

CCATGGTTGGTGTAATTTCTGCTGCTGCCATTAATCAAAGTATTGTGTACTCCATTGTTTCAGG

AAATGAAGAAGATACATTTGGAATTAATAACATCACAGGTGTTATCTATGTGAATGGACCTCTG

GATTATGAGACCAGGACAAGCTATGTACTTCGAGTCCAAGCTGATTCCCTGGAAGTGGTCCTTG

CCAATCTCCGAGTTCCTTCAAAAAGCAATACAGCTAAAGTATACATTGAGATTCAGGATGAAAA

TAATCAT

EC11 coding sequence (SEQ ID NO: 28)

CCCCCAGTGTTTCAGAAAAAATTCTACATCGGAGGTGTATCTGAAGATGCAAGAATGTTTACTT

CTGTACTCAGAGTGAAGGCTACTGATAAAGATACTGGCAATTATAGTGTCATGGCCTACAGACT

CATAATACCACCAATTAAAGAGGGAAAAGAAGGATTTGTAGTGGAAACATATACAGGGCTTATC

AAAACTGCTATGCTCTTCCATAATATGAGGAGATCCTACTTCAAGTTTCAAGTTATTGCAACTG

ACGACTATGGGAAGGGACTGAGCGGCAAAGCCGATGTACTCGTCTCCGTGGTCAATCAGCTGGA

T

MAD12 coding sequence (SEQ ID NO: 29)

ATGCAAGTCATTGTTTCCAATGTGCCTCCTACTCTAGTGGAAAAAAAGATAGAAGATCTTACAG

AGATCTTGGATCGCTATGTTCAGGAACAAATTCCTGGTGCCAAGGTCGTAGTGGAGTCCATTGG

AGCTCGCCGGCATGGAGATGCCTTTTTCCCTAGAAGATTACACCAAATGTGACTTGACTGTCTAT

-continued

GCAATTGACCCCCAAACCAACAGAGCCATCGATAGAAATGAGCTTTTTAAATTTTTGGATGGCA

AACTACTTGATATCAATAAAGACTTTCAGCCGTATTATGGGGAAGGAGGACGCATTCTGGAGAT

CCGGACTCCAGAGGCAGTGACCAGCATTAAAAAGAGAGGAGAAAGTCTAGGATACACAGAA

Transmembrane-cytoplasmic domain coding sequence (CD1 isoform)
                                            (SEQ ID NO: 30)
GGGGCCTTGTTGGCTCTGGCCTTCATCATCATCCTCTGCTGCATTCCTGCCATCTTGGTGGTTT

TGGTCAGCTACAGACAGTTTAAAGTACGTCAAGCTGAGTGTACAAAGACTGCACGAATTCAGGC

CGCATTACCCGCGGCTAAACCAGCAGTGCCGGCTCCTGCACCAGTGGCAGCGCCCCCGCCGCCG

CCGCCGCCTCCGCCAGGTGCGCATCTCTATGAAGAACTTGGAGACAGCTCAATGCATAATCTTT

TCCTTCTCTACCATTTTCAACAAAGCAGGGGAAATAACTCAGTCTCAGAAGACAGGAAACATCA

ACAAGTTGTGATGCCCTTTTCTTCCAATACTATTGAGGCTCACAAGTCAGCTCATGTAGACGGA

TCACTTAAGAGCAACAAACTGAAGTCTGCAAGAAAATTCACATTTCTATCTGATGAGGATGACT

TAAGTGCCCATAATCCCCTTTATAAGGAAAACATAAGTCAAGTATCAACAAATTCAGACATTTC

ACAGAGAACAGATTTTGTAGACCCATTTTCACCCAAAATACAAGCCAAGAGTAAGTCTCTGAGG

GGCCCAAGAGAAAGATTCAGAGGCTGTGGAGTCAGTCAGTCAGCTTACCCAGGAGGCTGATGA

GGAAAGTTCCAAATAGACCAGAGATCATAGATCTGCAGCAGTGGCAAGGCACCAGGCAGAAAGC

TGAAAATGAAAACACTGGAATCTGTACAAACAAAGAGGTAGCAGCAATCCATTGCTTACAACT

GAAGAGGCAAATTTGACAGAGAAGAGGAAATAAGGCAAGGTGAAACACTGATGATAGAAGGAA

CAGAACAGTTGAAATCTCTCTCTTCAGACTCTTCATTTTGCTTTCCCAGGCCTCACTTCTCATT

CTCCACTTTGCCAACTGTTTCAAGAACTGTGGAACTCAAATCAGAACCTAATGTCATCAGTTCT

CCTGCTGAGTGTTCCTTGGAACTTTCTCCTTCAAGGCCTTGTGTTTTACATTCTTCACTCTCTA

GGAGAGAGACACCTATTTGTATGTTACCTATTGAAACCGAAAGAAATATTTTTGAAAATTTTGC

CCATCCACCAAACATCTCTCCTTCTGCCTGTCCCCTTCCCCCTCCTCCTCCTATTTCTCCTCCT

TCTCCTCCTCCTGCTCCTGCTCCTCTTGCTCCTCCTCCTGACATTTCTCCTTTTTCTCTTTTTT

GTCCTCCTCCCTCTCCTCCTTCTATCCCTCTTCCTCTTCCTCCTCCTACATTTTTTTCCACTTTC

CGTTTCAACGTCTGGTCCCCCAACACCACCTCTTCTACCTCCATTTCCAACTCCTCTTCCTCCA

CCACCTCCTTCTATTCCTTGCCCTCCACCTCCTTCAGCTTCATTTCTGTCCACAGAGTGTGTCT

GTATAACAGGTGTTAAATGCACGACCAACTTGATGCCTGCCGAGAAAATTAAGTCCTCTATGAC

ACAGCTATCAACAACGACAGTGTGTAAAACAGACCCTCAGAGAGAACCAAAAGGCATCCTCAGA

CACGTTAAAAACTTAGCAGAACTTGAAAAATCAGTAGCTAACATGTACAGTCAAATAGAAAAAA

ACTATCTACGCACAAATGTTTCAGAACTTCAAACTATGTGCCCTTCAGAAGTAACAAATATGGA

AATCACATCTGAACAAAACAAGGGGAGTTTGAACAATATTGTCGAGGGAACTGAAAAACAATCT

CACAGTCAATCTACTTCACTGTAA

Transmembrane-cytoplasmic domain coding sequence (CD2 isoform)
                                            (SEQ ID NO: 61)
GGGGCCTTGTTGGCTCTGGCCTTCATCATCATCCTCTGCTGCATTCCTGCCATCTTGGTGGTTT

TGGTCAGCTACAGACAGTTTAAAGTACGTCAAGCTGAGTGTACAAAGACTGCACGAATTCAGGC

CGCATTACCCGCGGCTAAACCAGCAGTGCCGGCTCCTGCACCAGTGGCAGCGCCCCCGCCGCCG

CCGCCGCCTCCGCCAGGTGCGCATCTCTATGAAGAACTTGGAGACAGCTCAATGCATAAGTATG

AAATGCCTCAATATGGGAGTCGCCGTCGATTGTTACCACCAGCTGGACAGGAGGAATATGGTGA

GGTGGTTGGTGAAGCTGAGGAAGAATATGAGGAGGAAGAGGAAGAGCCAAAGAAAATTAAAAAA

CCAAAGGTTGAAATTAGAGAGCCTAGTGAGGAGGAAGAAGTAGTTGTAACTATCGAAAAACCAC

-continued

CAGCAGCTGAGCCTACATACACAACATGGAAGAGAGCCAGAATATTCCCCATGATTTTTAAGAA

AGTTAGAGGATTAGCTGATAAAAGAGGAATCGTTGACCTTGAGGGTGAAGAGTGGCAGAGACGC

CTTGAGGAAGAAGATAAAGATTATTTGAAACTCACTCTGGACCAAGAGGAAGCAACAGAAAGCA

CTGTAGAATCAGAGGAGGAATCCTCCAGCGACTATACTGAATACAGTGAAGAAGAGTCTGAGTT

CAGTGAGTCTGAGACTACAGAAGAGGAATCTGAGTCAGAGACACCCTCTGAGGAGGAGGAGAGT

TCCACCCCTGAATCAGAAGAATCGGAATCCACAGAGTCAGAAGGAGAAAAAGCAAGGAAAAACA

TTGTGCTTGCAAGAAGAAGGCCCATGGTTGAGGAGGTCAAGGAAGTCAAGGGTAGGAAAGAGGA

GCCACAAGAAGAACAAAAAGAACCTAAGATGGAAGAAGAAGAACACTCAGAAGAAGAAGAAAGT

GGACCAGCCCCTGTGGAAGAAAGTACAGACCCTGAAGCTCAAGATATCCCTGAAGAGGGCAGTG

CAGAATCAGCTTCGGTGGAAGGAGGTGTGGAAAGTGAGGAGGAATCAGAATCAGGTAGTAGTAG

CAGTAGTAGCGAAAGTCAGTCTGGAGGTCCATGGGGCTATCAGGTACCAGCGTATGACAGAAGC

AAGAATGCAAACCAAAAGAAGTCGCCAGGAGCAAACTCTGAAGGTTACAACACAGCACTTTGA

Transmembrane-cytoplasmic domain coding sequence (CD3 isoform)
                                                    (SEQ ID NO: 62)
GGGGCCTTGTTGGCTCTGGCCTTCATCATCATCCTCTGCTGCATTCCTGCCATCTTGGTGGTTT

TGGTCAGCTACAGACAGTTTAAAGTACGTCAAGCTGAGTGTACAAAGACTGCACGAATTCAGGC

CGCATTACCCGCGGCTAAACCAGCAGTGCCGGCTCCTGCACCAGTGGCAGCGCCCCCGCCGCCG

CCGCCGCCTCCGCCAGGTGCGCATCTCTATGAAGAACTTGGAGACAGCTCAATGCATAAGTATG

AAATGCCTCAATATGGGAGTCGCCGTCGATTGTTACCACCAGCTGGACAGGAGGAATATGGTGA

GGTGGTTGGTGAAGCTGAGGAAGAATATGAGGAGGAAGAGTGGGCAAGAAAAAGAATGATCAAG

TTAGTTGTTGATCGAGAGTATGAAACCAGCTCAACTGGAGAAGACAGTGCTCCTGAATGTCAGA

GAAACCGTCTTCACCATCCTAGTATCCACAGTAATATCAACGGCAATATATATATTGCACAGAA

TGGTTCTGTGGTGAGAACCCGCCGTGCCTGCCTCACGGACAACTTAAAAGTTGCTTCCCCTGTT

CGACTGGGAGGGCCCTTTAAGAAACTAGACAAGTTGGCAGTGACACATGAGGAGAATGTACCTC

TGAACACATTATCAAAGGGGCCATTTTCTACTGAAAAAATGAATGCAAGACCAACTCTGGTTAC

ATTTGCCCCTTGCCCTGTGGGGACTGACAATACAGCGGTGAAGCCACTAAGGAACAGGCTGAAA

AGCACAGTTGAACAGGAGTCCATGATTGACAGTAAGAACATCAAGGAGGCTTTGGAATTTCATA

GTGACCACACAGTCTGATGATGAAGAGCTTTGGATGGGCCCCTGGAACAACCTCCATATACC

AATGACAAAACTGTGA

In some embodiments, the coding sequence for mini-PCDH15 is less than 5000, 4500, 4000, 3500, 3000, 2500, 2000, or less nucleic acids. In some embodiments, the coding sequence for mini-PCDH15 is less than 5000 nucleic acids. In some embodiments, the coding sequence for mini-PCDH15 is less than 4600 base pairs. In other embodiments, the coding sequence for mini-PCDH15 is less than 3000 base pairs. The mini-PCDH15, as described herein, is small enough to be packaged into a single AAV-genome, and maintain the biological function of PCDH15.

In some embodiments, the mini-PCDH15 comprises a truncated extracellular portion of the full-length PCDH15. A truncated extracellular portion, as used herein, refers to an extracellular portion of a protein, which is shorter by at least 1, 2, 3, 4, 5, 6, 7, 8, 9, 10, 20, 30, 40, 50, 100, 200, 300, 400, 500, 600, 700, 800, or more amino acids less than the extracellular portion of a full-length protein. In some instances, the mini-PCDH15 comprises an extracellular portion at least 100, 200, 300, 400, 500, 600, 700, 800, 900 or 1000 amino acids less than full length PCDH15.

In some embodiments, the extracellular portion of a full-length PCDH15 comprises 11 extracellular calcium-binding (EC) domains. In some embodiments, the mini-PCDH15 does not comprise one or more EC domains compared to a full-length PCDH15. The full length PCDH15 includes 11 EC domains. In some embodiments, the mini-PCDH15 can have at least 1, 2, 3, 4, 5, 6, 7, 8, 9, 10, or 11 less EC domains compared to full-length PCDH15. In some embodiments, the mini-PCDH15 can have 3 EC domains less than full-length PCDH15. In some embodiments, the mini-PCDH15 can have 4 EC domains less than full-length PCDH15. In some embodiments, the mini-PCDH15 can have 5 EC domains less than full-length PCDH15. In some embodiments, the mini-PCDH15 can have 6 EC domains less than full-length PCDH15. In some embodiments, the mini-PCDH15 can have 7 EC domains less than full-length PCDH15. In some embodiments, the mini-PCDH15 can have 8 EC domains less than full-length PCDH15. In some embodiments, the mini-PCDH15 can have 9 EC domains less than full-length PCDH15. In some embodiments, the mini-PCDH15 can have 10 EC domains less than full-length PCDH15.

Exemplary EC domain sequences are set forth in SEQ ID NOs: 4 to 14. An exemplary full-length PCDH15 extracellular domain comprises 11 EC domains (e.g., EC1 at amino acid residues 27-148 of SEQ ID NO: 1; EC2 at amino acid residues 149-266 of SEQ ID NO: 1; EC3 at amino acid residues 267-396 of SEQ ID NO: 1; EC4 at amino acid residues 397-510 of SEQ ID NO: 1; EC5 at amino acid residues 511-616 of SEQ ID NO: 1; EC6 at amino acid residues 617-718 of SEQ ID NO: 1; EC7 at amino acid residues 719-820 of SEQ ID NO: 1; EC8 at amino acid residues 821-927 of SEQ ID NO: 1; EC9 at amino acid residues 928-1036 of SEQ ID NO: 1; EC10 at amino acid residues 1037-1145 of SEQ ID NO: 1; and EC11 at amino acid residues 1146-1252 of SEQ ID NO: 1).

Any of the mini-PCDH15, as described herein, may further comprises a MAD12 domain, a transmembrane domain and a cytoplasmic domain. In some embodiments, the cytoplasmic domain of PCDH15 is a splice isoform. In some embodiments, the splice isoform of PCDH15 is CD1, CD2 or CD3 isoforms. In some embodiments, the trans-membrane-cytoplasmic domain of the splice isoform comprises an amino acid sequence at least 60%, 70%, 75%, 80%, 85%, 90%, 91%, 92%, 93%, 94%, 95%, 96%, 97%, 98%, 99% or 100% identical to SEQ ID NO: 16. In some embodiments, the transmembrane-cytoplasmic domain of the splice isoform comprises an amino acid sequence at least 60%, 70%, 75%, 80%, 85%, 90%, 91%, 92%, 93%, 94%, 95%, 96%, 97%, 98%, 99% or 100% identical to SEQ ID NO: 59. In some embodiments, the transmembrane-cyto-plasmic domain of the splice isoform comprises an amino acid sequence at least 60%, 70%, 75%, 80%, 85%, 90%, 91%, 92%, 93%, 94%, 95%, 96%, 97%, 98%, 99% or 100% identical to SEQ ID NO: 60. In some embodiments, the CD2 splice form comprises an EC4 domain as set forth in amino acid sequence of SEQ ID NO: 119. Any of the mini-PCDH15 described herein, when having EC4 domain, may include the EC4 domain of SEQ ID NO: 7 or SEQ ID NO: 119.

An exemplary full-length human PCDH15 comprises 11 EC domains, MAD12 domain and TM-cytoplasmic domain (e.g., full length human PCDH15 CD1 splice form set forth in SEQ ID NO: 53, full length human PCDH15 CD2 splice form set forth in SEQ ID NO: 55, and full length human PCDH15 CD3 splice form set forth in SEQ ID NO: 57). In some embodiments, EC1 comprises amino acid residues 27-148 of SEQ ID NOs: 53, 55, and 57; EC2 comprises amino acid residues 149-266 of SEQ ID NOs: 53, 55, and 57; EC3 comprises amino acid residues 267-396 of SEQ ID NOs: 53, 55, and 57; EC4 comprises amino acid residues 397-510 of SEQ ID NOs: 53, and 57 or amino acid residues 397-517 of SEQ ID NO: 55; EC5 comprises amino acid residues 511-616 of SEQ ID NOs: 53, and 57 or amino acid residues 518-623 of SEQ ID NO: 55; EC6 comprises amino acid residues 617-718 of SEQ ID NOs: 53, and 57 or amino acid residues 624-725 of SEQ ID NO: 55; EC7 comprises amino acid residues 719-820 of SEQ ID NOs: 53, and 57 or amino acid residues 726-827 of SEQ ID NO: 55; EC8 comprises amino acid residues 821-927 of SEQ ID NOs: 53, and 57 or amino acid residues 828-934 of SEQ ID NO: 55; EC9 comprises amino acid residues 928-1036 of SEQ ID NOs: 53, and 57 or amino acid residues 935-1043 of SEQ ID NO: 55; EC10 comprises amino acid residues 1037-1145 of SEQ ID NOs: 53, and 57 or amino acid residues 1044-1152 of SEQ ID NO: 55; and EC11 comprises amino acid residues 1146-1252 of SEQ ID NOs: 53 and 57 or amino acid residues 1153-1259 of SEQ ID NO: 55.

In some embodiments, the mini-PCDH15 does not comprise amino acid residues 719 to 820 of SEQ ID NO: 1, 53, or 57, or amino acid residues 726-827 of SEQ ID NO: 55 (EC7). Alternatively or in addition, the mini-PCDH15 may not comprise amino acid residues 397 to 510 of SEQ ID NOs: 1, 53 or 57, or amino acid residues 397-517 of SEQ ID NO: 55 (EC4). Alternatively or in addition, the mini-PCDH15 may not comprise amino acid residues 821 to 927 of SEQ ID NOs: 1, 53 or 57, or amino acid residues 828-934 of SEQ ID NO: 55 (EC8). Alternatively or in addition, the mini-PCDH15 may not comprise amino acid residues 511 to 616 of SEQ ID NOs: 1, 53 or 57, or amino acid residues 518-623 of SEQ ID NO: 55 (EC5). Alternatively or in addition, the mini-PCDH15 may not comprise amino acid residues 617 to 718 of SEQ ID NOs: 1, 53 or 57, or amino acid residues 624-725 of SEQ ID NO: 55 (EC6). Alternatively or in addition, the mini-PCDH15 may not comprise amino acid residues 928 to 1036 of SEQ ID NOs: 1, 53 or 57, or amino acid residues 935-1043 of SEQ ID NO: 55 (EC9). Alternatively or in addition, the mini-PCDH15 may not comprise amino acid residues 1037 to 1145 of SEQ ID NOs: 1, 53, 55 or 57 (EC10). Alternatively or in addition, the mini-PCDH15 may not comprise amino acid residues 27 to 148 of SEQ ID NOs: 1, 53, 55 or 57 (EC1). Alternatively or in addition, the mini-PCDH15 may not comprise amino acid residues 149-266 of SEQ ID NOs: 1, 53, 55 or 57 (EC2). Alternatively or in addition, the mini-PCDH15 may not comprise amino acid residues 267 to 396 of SEQ ID NOs: 1, 53, 55 or 57 (EC3). Alternatively or in addition, the mini-PCDH15 may not comprise amino acid residues 1146 to 1252 of SEQ ID NOs: 1, 53, or 57, or amino acid residues 1153-1259 of SEQ ID NO: 55(EC11).

In some embodiments, the mini-PCDH15 comprises one EC domain in the extracellular region (e.g., EC1, EC2, EC3, EC4, EC5, EC6, EC7, EC8, EC9, EC10 or EC11) of a full length PCDH15 extracellular domain set forth in SEQ ID NO: 1 or full length PCDH15 set forth in SEQ ID NOs: 53, 55 or 57. In some embodiments, the mini-PCDH15 comprises two EC domains in the extracellular region (e.g., any combination of two EC domains from among EC1, EC2, EC3, EC4, EC5, EC6, EC7, EC8, EC9, EC10 or EC11) of a full length PCDH15 extracellular domain set forth in SEQ ID NO: 1 or full length PCDH15 set forth in SEQ ID NOs: 53, 55 or 57. In some embodiments, the mini-PCDH15 comprises three EC domains in the extracellular region (e.g., any combination of three EC domains from among EC1, EC2, EC3, EC4, EC5, EC6, EC7, EC8, EC9, EC10 or EC11) of a full length PCDH15 extracellular domain set forth in SEQ ID NO: 1 or full length PCDH15 set forth in SEQ ID NOs: 53, 55 or 57. In some embodiments, the mini-PCDH15 comprises four EC domains in the extracellular region (e.g., any combination of four EC domains from among EC1, EC2, EC3, EC4, EC5, EC6, EC7, EC8, EC9, EC10 or EC11) of a full length PCDH15 extracellular domain set forth in SEQ ID NO: 1 or full length PCDH15 set forth in SEQ ID NOs: 53, 55 or 57. In some embodiments, the mini-PCDH15 comprises five EC domains in the extracellular region (e.g., any combination of five EC domains from among EC1, EC2, EC3, EC4, EC5, EC6, EC7, EC8, EC9, EC10 or EC11) of a full length PCDH15 extracellular domain set forth in SEQ ID NO: 1 or full length PCDH15 set forth in SEQ ID NOs: 53, 55 or 57. In some embodiments, the mini-PCDH15 comprises six EC domains in the extracellular region (e.g., any combination of six EC domains from among EC1, EC2, EC3, EC4, EC5, EC6, EC7, EC8, EC9, EC10 or EC11) of a full length PCDH15 extracellular domain set forth in SEQ ID NO: 1 or full length PCDH15 set forth in SEQ ID NOs: 53, 55 or 57. In some embodiments, the mini-PCDH15 comprises seven EC domains in the extracellular region (e.g., any combination of seven EC domains from among EC1, EC2, EC3, EC4, EC5, EC6, EC7, EC8, EC9, EC10 or EC11) of a full length PCDH15 extracellular domain set forth in SEQ ID NO: 1 or full length PCDH15 set forth in SEQ ID NOs: 53, 55 or 57. In some embodiments, the mini-PCDH15 comprises eight EC domains in the extracellular region (e.g., any combination of eight EC domains from among EC1, EC2, EC3, EC4, EC5, EC6, EC7, EC8, EC9, EC10 or EC11) of a full length PCDH15 extracellular domain set forth in SEQ ID NO: 1 or full length PCDH15 set forth in SEQ ID NOs: 53, 55 or 57. In some embodiments, the mini-PCDH15 comprises nine EC domains in the extracellular region (e.g., any combination of nice EC domains from among EC1, EC2, EC3, EC4, EC5, EC6, EC7, EC8, EC9, EC10 or EC11) of a full length PCDH15 extracellular domain set forth in SEQ ID NO: 1 or full length PCDH15 set forth in SEQ ID NOs: 53, 55 or 57. In some embodiments, the mini-PCDH15 comprises ten EC domains in the extracellular region (e.g., any combination of ten EC domains from among EC1, EC2, EC3, EC4, EC5, EC6, EC7, EC8, EC9, EC10 or EC11) of a full length PCDH15 extracellular domain set forth in SEQ ID NO: 1 or full length PCDH15 set forth in SEQ ID NOs: 53, 55 or 57.

As used herein, the term "sequence identity" refers to the percentage of amino acid (or nucleic acid) residues of a candidate sequence that are identical to the amino acid (or nucleic acid) residues of a reference sequence, e.g., any of the mini-PCDH15 disclosed herein and their coding sequences, after aligning the sequences and introducing gaps, if necessary, to achieve the maximum percent identity (e.g., gaps can be introduced in one or both of the candidate and reference sequences for optimal alignment and non-homologous sequences can be disregarded for comparison purposes). Alteration of the amino acid sequence or nucleic acid coding sequences can be obtained by deletion, addition or substitution of residues of the reference sequence. Alignment for purposes of determining percent identity can be achieved in various ways that are within the skill in the art, for instance, using publicly available computer software, such as BLAST, BLAST-2, BLAST-P, BLAST-N, BLAST-X, WU-BLAST-2, ALIGN, ALIGN-2, CLUSTAL, or Megalign (DNASTAR) software. Those skilled in the art can determine appropriate parameters for measuring alignment, including any algorithms needed to achieve maximal alignment over the full length of the sequences being compared. For instance, the percent amino acid (or nucleic acid) sequence identity of a given candidate sequence to, with, or against a given reference sequence (which can alternatively be phrased as a given candidate sequence that has or includes a certain percent amino acid (or nucleic acid) sequence identity to, with, or against a given reference sequence) is calculated as follows:

100×(fraction of A/B)

where A is the number of amino acid (or nucleic acid) residues scored as identical in the alignment of the candidate sequence and the reference sequence, and where B is the total number of amino acid (or nucleic acid) residues in the reference sequence. In particular, a reference sequence aligned for comparison with a candidate sequence can show that the candidate sequence exhibits from, e.g., 50% to 100% identity across the full length of the candidate sequence or a selected portion of contiguous amino acid (or nucleic acid) residues of the candidate sequence. The length of the candidate sequence aligned for comparison purpose is at least 30%, e.g., at least 40%, e.g., at least 50%, 60%, 70%, 80%, 90%, or 100% of the length of the reference sequence. When a position in the candidate sequence is occupied by the same amino acid (or nucleic acid) residue as the corresponding position in the reference sequence, then the molecules are identical at that position.

In some embodiments, the mini-PCDH15 has 3 EC domains less than full-length PCDH15. In some examples, the mini-PCDH15 lacks EC4, EC7 and EC8 domain. In some embodiments, the mini-PCDH15 includes EC1-EC2-EC3-EC5-EC6-EC9-EC10-EC11 of SEQ ID NO: 1, 53, 55, or 57. In one example, the mini-PCDH15 comprises an amino acid sequence at least 60%, 70%, 75%, 80%, 85%, 90%, 91%, 92%, 93%, 94%, 95%, 96%, 97%, 98%, 99% or 100% identical to SEQ ID NO: 31, 75, or 76. In some embodiments, the nucleic acid encoding the mini-PCDH15 lacking EC4, EC7 and EC8 comprises a nucleic acid sequence at least 60%, 70%, 75%, 80%, 85%, 90%, 91%, 92%, 93%, 94%, 95%, 96%, 97%, 98%, 99% or 100% identical to SEQ ID NO: 32, 77, or 78.

An exemplary amino acid sequence of a mini-PCDH15 lacking EC4, EC7 and EC8 is set forth in SEQ ID NO: 31 (mini-PCDH15 V1: includes EC1-EC2-EC3-EC5-EC6-EC9-EC10-EC11-MAD12-TM-cyto CD1; different domains alternating in bold and regular font):

(SEQ ID NO: 31)

MFRQFYLWTCLASGIILGSLFEICLGQYDDDWQYEDCKLARGGPPATIVA

IDEESRNGTILVDNMLIKGTAGGPDPTIELSLKDNVDYWVLMDPVKQMLF

LNSTGRVLDRDPPMNIHSIVVQVQCINKKVGTIIYHEVRIVVRDRNDNSP

TFKHESYYATVNELTPVGTTIFTGFSGDNGATDIDDGPNGQIEYVIQYNP

DDPTSNDTFEIPLMLTGNIVLRKRLNYEDKTRYFVIIQANDRAQNLNERR

TTTTTLTVDVLDGDDLGPMFLPCVLVPNTRDCRPLTYQAAIPELRTPEEL

NPIIVTPPIQAIDQDRNIQPPSDRPGILYSILVGTPEDYPRFFHMHPRTA

ELSLLEPVNRDFHQKFDLVIKAEQDNGHPLPAFAGLHIEILDENNQTPTF

PEISYDVYVYTDMRPGDSVIQLTAVDADEGSNGEITYEILVGAQGDFIIN

KTTGLITIAPGVEMIVGRTYALTVQAADNAPPAERRNSICTVYIEVLPPN

NQSPPRFPQLMYSLEISEAMRVGAVLLNLQATDREGDSITYAIENGDPQR

VFNLSETTGILTLGKALDRESTDRYILIITASDGRPDGTSTATVNIVVT

DVNDNPPVFSKRIYKGMVAPDAVKGTPITTVYAEDADPPGLPASRVRYRV

DDVQFPYPASIFEVEEDSGRVITRVNLNEEPTTIFKLVVVAFDDGEPVMS

SSATVKILVLHPGEIPRFTQEEYRPPPVSELATKGTMVGVISAAAINQSI

VYSIVSGNEEDTFGINNITGVIYVNGPLDYETRTSYVLRVQADSLEVVLA

NLRVPSKSNTAKVYIEIQDENNHPPVFQKKFYIGGVSEDARMFTSVLRVK

ATDKDTGNYSVMAYRLIIPPIKEGKEGFVVETYTGLIKTAMLFHNMRRSY

FKFQVIATDDYGKGLSGKADVLVSVVNQLDMQVIVSNVPPTLVEKKIEDL

TEILDRYVQEQIPGAKVVVESIGARRHGDAFSLEDYTKCDLTVYAIDPQT

NRAIDRNELFKFLDGKLLDINKDFQPYYGEGGRILEIRTPEAVTSIKKRG

-continued

ESLGYTEGALLALAFIIILCCIPAILVVLVSYRQFKVRQAECTKTARIQA

ALPAAKPAVPAPAPVAAPPPPPPPPPGAHLYEELGDSSMHNLFLLYHFQQ

SRGNNSVSEDRKHQQVVMPFSSNTIEAHKSAHVDGSLKSNKLKSARKFTF

LSDEDDLSAHNPLYKENISQVSTNSDISQRTDFVDPFSPKIQAKSKSLRG

PREKIQRLWSQSVSLPRRLMRKVPNRPEIIDLQQWQGTRQKAENENTGIC

TNKRGSSNPLLTTEEANLTEKEEIRQGETLMIEGTEQLKSLSSDSSFCFP

RPHFSFSTLPTVSRTVELKSEPNVISSPAECSLELSPSRPCVLHSSLSRR

ETPICMLPIETERNIFENFAHPPNISPSACPLPPPPPISPPSPPPAPAPL

APPPDISPFSLFCPPPSPPSIPLPLPPPTFFPLSVSTSGPPTPPLLPPFP

TPLPPPPPSIPCPPPPSASFLSTECVCITGVKCTTNLMPAEKIKSSMTQL

STTTTVCKTDPQREPKGILRHVKNLAELEKSVANMYSQIEKNYLRTNVSEL

QTMCPSEVTNMEITSEQNKGSLNNIVEGTEKQSHSQSTSL

An exemplary amino acid sequence of a mini-PCDH15 lacking EC4, EC7 and EC8 is set forth in SEQ ID NO: 75 (mini-PCDH15 V1: includes EC1-EC2-EC3-EC5-EC6-EC9-EC10-EC11-MAD12-TM-cyto CD2; different domains alternating in bold and regular font):

(SEQ ID NO: 75)
MFRQFYLWTCLASGIILGSLFEICLGQYDDDWQYEDCKLARGGPPATIVA

IDEESRNGTILVDNMLIKGTAGGPDPTIELSLKDNVDYWVLMDPVKQMLF

LNSTGRVLDRDPPMNIHSIVVQVQCINKKVGTIIYHEVRIVVRDRNDNSP

TFKHESYYATVNELTPVGTTIFTGFSGDNGATDIDDGPNGQIEYVIQYNP

DDPTSNDTFEIPLMLTGNIVLRKRLNYEDKTRYFVIIQANDRAQNLNERR

TTTTTLTVDVLDGDDLGPMFLPCVLVPNTRDCRPLTYQAAIPELRTPEEL

NPIIVTPPIQAIDQDRNIQPPSDRPGILYSILVGTPEDYPRFFHMHPRTA

ELSLLEPVNRDFHQKFDLVIKAEQDNGHPLPAFAGLHIEILDENNQTPTF

PEISYDVYVYTDMRPGDSVIQLTAVDADEGSNGEITYEILVGAQGDFIIN

KTTGLITIAPGVEMIVGRTYALTVQAADNAPPAERRNSICTVYIEVLPPN

NQSPPRFPQLMYSLEISEAMRVGAVLLNLQATDREGDSITYAIENGDPQR

VFNLSETTGILTLGKALDRESTDRYILIITASDGRPDGTSTATVNIVVT

DVNDNPPVFSKRIYKGMVAPDAVKGTPITTVYAEDADPPGLPASRVRYRV

DDVQFPYPASIFEVEEDSGRVITRVNLNEEPTTIFKLVVVAFDDGEPVMS

SSATVKILVLHPGEIPRFTQEEYRPPPVSELATKGTMVGVISAAAINQSI

VYSIVSGNEEDTFGINNITGVIYVNGPLDYETRTSYVLRVQADSLEVVLA

NLRVPSKSNTAKVYIEIQDENNHPPVFQKKFYIGGVSEDARMFTSVLRVK

ATDKDTGNYSVMAYRLIIPPIKEGKEGFVVETYTGLIKTAMLFHNMRRSY

FKFQVIATDDYGKGLSGKADVLVSVVNQLDMQVIVSNVPPTLVEKKIEDL

TEILDRYVQEQIPGAKVVVESIGARRHGDAFSLEDYTKCDLTVYAIDPQT

NRAIDRNELFKFLDGKLLDINKDFQPYYGEGGRILEIRTPEAVTSIKKRG

ESLGYTEGALLALAFIIILCCIPAILVVLVSYRQFKVRQAECTKTARIQA

ALPAAKPAVPAPAPVAAPPPPPPPPPGAHLYEELGDSSMHKYEMPQYGSR

RRLLPPAGQEEYGEVVGEAEEEYEEEEEEPKKIKKPKVEIREPSEEEEVV

-continued

VTIEKPPAAEPTYTTWKRARIFPMIFKKVRGLADKRGIVDLEGEEWQRRL

EEEDKDYLKLTLDQEEATESTVESEEESSSDYTEYSEEESEFSESETTEE

ESESETPSEEEESSTPESEESESTESEGEKARKNIVLARRRPMVEEVKEV

KGRKEEPQEEQKEPKMEEEEHSEEEESGPAPVEESTDPEAQDIPEEGSAE

SASVEGGVESEEESESGSSSSSSESQSGGPWGYQVPAYDRSKNANQKKSP

GANSEGYNTAL

An exemplary amino acid sequence of a mini-PCDH15 lacking EC4, EC7 and EC8 is set forth in SEQ ID NO: 76 (mini-PCDH15 V1: includes EC1-EC2-EC3-EC5-EC6-EC9-EC10-EC11-MAD12-TM-cyto CD3; different domains alternating in bold and regular font):

(SEQ ID NO: 76)
MFRQFYLWTCLASGIILGSLFEICLGQYDDDWQYEDCKLARGGPPATIVA

IDEESRNGTILVDNMLIKGTAGGPDPTIELSLKDNVDYWVLMDPVKQMLF

LNSTGRVLDRDPPMNIHSIVVQVQCINKKVGTIIYHEVRIVVRDRNDNSP

TFKHESYYATVNELTPVGTTIFTGFSGDNGATDIDDGPNGQIEYVIQYNP

DDPTSNDTFEIPLMLTGNIVLRKRLNYEDKTRYFVIIQANDRAQNLNERR

TTTTTLTVDVLDGDDLGPMFLPCVLVPNTRDCRPLTYQAAIPELRTPEEL

NPIIVTPPIQAIDQDRNIQPPSDRPGILYSILVGTPEDYPRFFHMHPRTA

ELSLLEPVNRDFHQKFDLVIKAEQDNGHPLPAFAGLHIEILDENNQTPTF

PEISYDVYVYTDMRPGDSVIQLTAVDADEGSNGEITYEILVGAQGDFIIN

KTTGLITIAPGVEMIVGRTYALTVQAADNAPPAERRNSICTVYIEVLPPN

NQSPPRFPQLMYSLEISEAMRVGAVLLNLQATDREGDSITYAIENGDPQR

VFNLSETTGILTLGKALDRESTDRYILIITASDGRPDGTSTATVNIVVTD

VNDNPPVFSKRIYKGMVAPDAVKGTPITTVYAEDADPPGLPASRVRYRVD

DVQFPYPASIFEVEEDSGRVITRVNLNEEPTTIFKLVVVAFDDGEPVMSS

SATVKILVLHPGEIPRFTQEEYRPPPVSELATKGTMVGVISAAAINQSIV

YSIVSGNEEDTFGINNITGVIYVNGPLDYETRTSYVLRVQADSLEVVLAN

LRVPSKSNTAKVYIEIQDENNHPPVFQKKFYIGGVSEDARMFTSVLRVKA

TDKDTGNYSVMAYRLIIPPIKEGKEGFVVETYTGLIKTAMLFHNMRRSYF

KFQVIATDDYGKGLSGKADVLVSVVNQLDMQVIVSNVPPTLVEKKIEDLT

EILDRYVQEQIPGAKVVVESIGARRHGDAFSLEDYTKCDLTVYAIDPQTN

RAIDRNELFKFLDGKLLDINKDFQPYYGEGGRILEIRTPEAVTSIKKRGE

SLGYTEGALLALAFIIILCCIPAILVVLVSYRQFKVRQAECTKTARIQAA

LPAAKPAVPAPAPVAAPPPPPPPPPGAHLYEELGDSSMHKYEMPQYGSRR

RLLPPAGQEEYGEVVGEAEEEYEEEEWARKRMIKLVVDREYETSSTGEDS

APECQRNRLHHPSIHSNINGNIYIAQNGSVVRTRRACLTDNLKVASPVRL

GGPFKKLDKLAVTHEENVPLNTLSKGPFSTEKMNARPTLVTFAPCPVGTD

NTAVKPLRNRLKSTVEQESMIDSKNIKEALEFHSDHTQSDDEELWMGPWN

NLHIPMTKL

An exemplary nucleic acid sequence encoding a mini-PCDH15 lacking EC4, EC7 and EC8 (V1) is set forth in SEQ ID NO: 32 (mini-PCDH15 V1: includes EC1-EC2-EC3-EC5-EC6-EC9-EC10-EC11-MAD12-TM-cyto CD1):

(SEQ ID NO: 32)

```
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAACGCCAACCTTCCCTGAAATATCCTATG

ATGTGTATGTTTATACAGACATGAGACCTGGGGACAGTGTCATACAGCTCACTGCAGTCGACGC

AGACGAAGGGTCAAATGGGGAGATCACATATGAAATCCTTGTTGGGGCTCAGGGAGACTTCATC

ATCAATAAAACAACAGGGCTTATCACCATCGCTCCAGGGGTGGAAATGATAGTCGGGCGGACTT

ACGCACTCACGGTCCAAGCAGCGGATAATGCTCCTCCTGCAGAGCGAAGGAACTCCATCTGCAC

TGTGTATATTGAAGTGCTTCCACCAAATAATCAAAGCCCTCCTCGCTTCCCACAGCTGATGTAT

AGCCTTGAAATTAGTGAAGCCATGAGGGTTGGTGCTGTTTTATTAAATCTACAGGCAACTGATC

GAGAGGGAGACTCAATAACATATGCCATTGAGAATGGAGATCCTCAGAGAGTTTTTAATCTTTC

AGAAACCACGGGGATTCTAACCTTAGGGAAAGCACTGGACAGGGAAAGCACTGATCGCTACATT

CTGATCATCACAGCTTCAGATGGCAGGCCAGATGGGACCTCAACTGCCACAGTAAACATAGTGG

TGACAGATGTCAATGACAATCCTCCTGTCTTTAGTAAACGAATATACAAAGGGATGGTGGCTCC

GGATGCAGTCAAGGGTACACCTATCACAACAGTTTATGCTGAAGATGCAGACCCTCCTGGATTA

CCTGCAAGTCGTGTGAGGTATAGAGTAGATGATGTACAGTTTCCTTACCCTGCCAGTATTTTTG

AAGTGGAAGAAGATTCTGGAAGAGTAATAACACGAGTCAATCTTAATGAAGAACCTACAACAAT

TTTTAAGTTGGTGGTGGTTGCTTTTGATGATGGGGAGCCTGTGATGTCCAGCAGTGCCACAGTG

AAGATTCTTGTCTTACATCCTGGTGAGATCCCACGCTTCACACAGGAGGAATATAGACCTCCTC

CAGTAAGTGAACTTGCCACCAAAGGGACCATGGTTGGTGTAATTTCTGCTGCTGCCATTAATCA

AAGTATTGTGTACTCCATTGTTTCAGGAAATGAAGAAGATACATTTGGAATTAATAACATCACA

GGTGTTATCTATGTGAATGGACCTCTGGATTATGAGACCAGGACAAGCTATGTACTTCGAGTCC

AAGCTGATTCCCTGGAAGTGGTCCTTGCCAATCTCCGAGTTCCTTCAAAAAGCAATACAGCTAA

AGTATACATTGAGATTCAGGATGAAAATAATCATCCCCCAGTGTTTCAGAAAAAATTCTACATC
```

-continued

```
GGAGGTGTATCTGAAGATGCAAGAATGTTTACTTCTGTACTCAGAGTGAAGGCTACTGATAAAG

ATACTGGCAATTATAGTGTCATGGCCTACAGACTCATAATACCACCAATTAAAGAGGGAAAAGA

AGGATTTGTAGTGGAAACATATACAGGGCTTATCAAAACTGCTATGCTCTTCCATAATATGAGG

AGATCCTACTTCAAGTTTCAAGTTATTGCAACTGACGACTATGGGAAGGGACTGAGCGGCAAAG

CCGATGTACTCGTCTCCGTGGTCAATCAGCTGGATATGCAAGTCATTGTTTCCAATGTGCCTCC

TACTCTAGTGGAAAAAAAGATAGAAGATCTTACAGAGATCTTGGATCGCTATGTTCAGGAACAA

ATTCCTGGTGCCAAGGTCGTAGTGGAGTCCATTGGAGCTCGCCGGCATGGAGATGCCTTTTCCC

TAGAAGATTACACCAAATGTGACTTGACTGTCTATGCAATTGACCCCCAAACCAACAGAGCCAT

CGATAGAAATGAGCTTTTTAAATTTTTGGATGGCAAACTACTTGATATCAATAAAGACTTTCAG

CCGTATTATGGGGAAGGAGGACGCATTCTGGAGATCCGGACTCCAGAGGCAGTGACCAGCATTA

AAAAGAGAGGAGAAAGTCTAGGATACACAGAAGGGGCCTTGTTGGCTCTGGCCTTCATCATCAT

CCTCTGCTGCATTCCTGCCATCTTGGTGGTTTTGGTCAGCTACAGACAGTTTAAAGTACGTCAA

GCTGAGTGTACAAAGACTGCACGAATTCAGGCCGCATTACCCGCGGCTAAACCAGCAGTGCCGG

CTCCTGCACCAGTGGCAGCGCCCCCGCCGCCGCCGCCGCCTCCGCCAGGTGCGCATCTCTATGA

AGAACTTGGAGACAGCTCAATGCATAATCTTTTCCTTCTCTACCATTTTCAACAAAGCAGGGGA

AATAACTCAGTCTCAGAAGACAGGAAACATCAACAAGTTGTGATGCCCTTTTCTTCCAATACTA

TTGAGGCTCACAAGTCAGCTCATGTAGACGGATCACTTAAGAGCAACAAACTGAAGTCTGCAAG

AAAATTCACATTTCTATCTGATGAGGATGACTTAAGTGCCCATAATCCCCTTTATAAGGAAAAC

ATAAGTCAAGTATCAACAAATTCAGACATTTCACAGAGAACAGATTTTGTAGACCCATTTTCAC

CCAAAATACAAGCCAAGAGTAAGTCTCTGAGGGGCCCAAGAGAAAAGATTCAGAGGCTGTGGAG

TCAGTCAGTCAGCTTACCCAGGAGGCTGATGAGGAAAGTTCCAAATAGACCAGAGATCATAGAT

CTGCAGCAGTGGCAAGGCACCAGGCAGAAAGCTGAAAATGAAACACTGGAATCTGTACAAACA

AAAGAGGTAGCAGCAATCCATTGCTTACAACTGAAGAGGCAAATTTGACAGAGAAAGAGGAAAT

AAGGCAAGGTGAAACACTGATGATAGAAGGAACAGAACAGTTGAAATCTCTCTCTTCAGACTCT

TCATTTTGCTTTCCCAGGCCTCACTTCTCATTCTCCACTTTGCCAACTGTTTCAAGAACTGTGG

AACTCAAATCAGAACCTAATGTCATCAGTTCTCCTGCTGAGTGTTCCTTGGAACTTTCTCCTTC

AAGGCCTTGTGTTTTACATTCTTCACTCTCTAGGAGAGAGACACCTATTTGTATGTTACCTATT

GAAACCGAAAGAAATATTTTTGAAAATTTTGCCCATCCACCAAACATCTCTCCTTCTGCCTGTC

CCCTTCCCCCTCCTCCTCCTATTTCTCCTCCTTCTCCTCCTCCTGCTCCTGCTCCTCTTGCTCC

TCCTCCTGACATTTCTCCTTTTTCTCTTTTTTTGTCCTCCTCCCTCTCCTCCTTCTATCCCTCTT

CCTCTTCCTCCTCCTACATTTTTTCCACTTTCCGTTTCAACGTCTGGTCCCCCAACACCACCTC

TTCTACCTCCATTTCCAACTCCTCTTCCTCCACCACCTCCTTCTATTCCTTGCCCTCCACCTCC

TTCAGCTTCATTTCTGTCCACAGAGTGTGTCTGTATAACAGGTGTTAAATGCACGACCAACTTG

ATGCCTGCCGAGAAAATTAAGTCCTCTATGACACAGCTATCAACAACGACAGTGTGTAAAACAG

ACCCTCAGAGAGAACCAAAAGGCATCCTCAGCACGTTAAAAACTTAGCAGAACTTGAAAAATC

AGTAGCTAACATGTACAGTCAAATAGAAAAAAACTATCTACGCACAAATGTTTCAGAACTTCAA

ACTATGTGCCCTTCAGAAGTAACAAATATGGAAATCACATCTGAACAAAACAAGGGGAGTTTGA

ACAATATTGTCGAGGGAACTGAAAAACAATCTCACAGTCAATCTACTTCACTGTAA
```

An exemplary nucleic acid sequence encoding a mini-PCDH15 lacking EC4, EC7 and EC8 (V1) is set forth in SEQ ID NO: 77 (mini-PCDH15 V1: includes EC1-EC2-EC3-EC5-EC6-EC9-EC10-EC11-MAD12-TM-cyto CD2):

(SEQ ID NO: 77)
```
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAACGCCAACCTTCCCTGAAATATCCTATG

ATGTGTATGTTTATACAGACATGAGACCTGGGGACAGTGTCATACAGCTCACTGCAGTCGACGC

AGACGAAGGGTCAAATGGGGAGATCACATATGAAATCCTTGTTGGGGCTCAGGGAGACTTCATC

ATCAATAAAACAACAGGGCTTATCACCATCGCTCCAGGGGTGGAAATGATAGTCGGGCGGACTT

ACGCACTCACGGTCCAAGCAGCGGATAATGCTCCTCCTGCAGAGCGAAGGAACTCCATCTGCAC

TGTGTATATTGAAGTGCTTCCACCAAATAATCAAAGCCCTCCTCGCTTCCCACAGCTGATGTAT

AGCCTTGAAATTAGTGAAGCCATGAGGGGTTGGTGCTGTTTTATTAAATCTACAGGCAACTGATC

GAGAGGGAGACTCAATAACATATGCCATTGAGAATGGAGATCCTCAGAGAGTTTTTAATCTTTC

AGAAACCACGGGGATTCTAACCTTAGGGAAAGCACTGGACAGGGAAAGCACTGATCGCTACATT

CTGATCATCACAGCTTCAGATGGCAGGCCAGATGGGACCTCAACTGCCACAGTAAACATAGTGG

TGACAGATGTCAATGACAATCCTCCTGTCTTTAGTAAACGAATATACAAAGGGATGGTGGCTCC

GGATGCAGTCAAGGGTACACCTATCACAACAGTTTATGCTGAAGATGCAGACCCTCCTGGATTA

CCTGCAAGTCGTGTGAGGTATAGAGTAGATGATGTACAGTTTCCTTACCCTGCCAGTATTTTTG

AAGTGGAAGAAGATTCTGGAAGAGTAATAACACGAGTCAATCTTAATGAAGAACCTACAACAAT

TTTTAAGTTGGTGGTGGTTGCTTTTGATGATGGGGAGCCTGTGATGTCCAGCAGTGCCACAGTG

AAGATTCTTGTCTTACATCCTGGTGAGATCCCACGCTTCACACAGGAGGAATATAGACCTCCTC

CAGTAAGTGAACTTGCCACCAAAGGGACCATGGTTGGTGTAATTTCTGCTGCTGCCATTAATCA

AAGTATTGTGTACTCCATTGTTTCAGGAAATGAAGAAGATACATTTGGAATTAATAACATCACA

GGTGTTATCTATGTGAATGGACCTCTGGATTATGAGACCAGGACAAGCTATGTACTTCGAGTCC

AAGCTGATTCCCTGGAAGTGGTCCTTGCCAATCTCCGAGTTCCTTCAAAAAGCAATACAGCTAA

AGTATACATTGAGATTCAGGATGAAAATAATCATCCCCCAGTGTTTCAGAAAAAATTCTACATC
```

-continued

```
GGAGGTGTATCTGAAGATGCAAGAATGTTTACTTCTGTACTCAGAGTGAAGGCTACTGATAAAG

ATACTGGCAATTATAGTGTCATGGCCTACAGACTCATAATACCACCAATTAAAGAGGGAAAAGA

AGGATTTGTAGTGGAAACATATACAGGGCTTATCAAAACTGCTATGCTCTTCCATAATATGAGG

AGATCCTACTTCAAGTTTCAAGTTATTGCAACTGACGACTATGGGAAGGGACTGAGCGGCAAAG

CCGATGTACTCGTCTCCGTGGTCAATCAGCTGGATATGCAAGTCATTGTTTCCAATGTGCCTCC

TACTCTAGTGGAAAAAAAGATAGAAGATCTTACAGAGATCTTGGATCGCTATGTTCAGGAACAA

ATTCCTGGTGCCAAGGTCGTAGTGGAGTCCATTGGAGCTCGCCGGCATGGAGATGCCTTTTCCC

TAGAAGATTACACCAAATGTGACTTGACTGTCTATGCAATTGACCCCCAAACCAACAGAGCCAT

CGATAGAAATGAGCTTTTTAAATTTTTGGATGGCAAACTACTTGATATCAATAAAGACTTTCAG

CCGTATTATGGGGAAGGAGGACGCATTCTGGAGATCCGGACTCCAGAGGCAGTGACCAGCATTA

AAAAGAGAGGAGAAAGTCTAGGATACACAGAAGGGGCCTTGTTGGCTCTGGCCTTCATCATCAT

CCTCTGCTGCATTCCTGCCATCTTGGTGGTTTTGGTCAGCTACAGACAGTTTAAAGTACGTCAA

GCTGAGTGTACAAAGACTGCACGAATTCAGGCCGCATTACCCGCGGCTAAACCAGCAGTGCCGG

CTCCTGCACCAGTGGCAGCGCCCCGCCGCCGCCGCCGCCTCCGCCAGGTGCGCATCTCTATGA

AGAACTTGGAGACAGCTCAATGCATAAGTATGAAATGCCTCAATATGGGAGTCGCCGTCGATTG

TTACCACCAGCTGGACAGGAGGAATATGGTGAGGTGGTTGGTGAAGCTGAGGAAGAATATGAGG

AGGAAGAGGAAGAGCCAAAGAAAATTAAAAAACCAAAGGTTGAAATTAGAGAGCCTAGTGAGGA

GGAAGAAGTAGTTGTAACTATCGAAAAACCACCAGCAGCTGAGCCTACATACACAACATGGAAG

AGAGCCAGAATATTCCCCATGATTTTTAAGAAAGTTAGAGGATTAGCTGATAAAAGAGGAATCG

TTGACCTTGAGGGTGAAGAGTGGCAGAGACGCCTTGAGGAAGAAGATAAAGATTATTTGAAACT

CACTCTGGACCAAGAGGAAGCAACAGAAAGCACTGTAGAATCAGAGGAGGAATCCTCCAGCGAC

TATACTGAATACAGTGAAGAAGAGTCTGAGTTCAGTGAGTCTGAGACTACAGAAGAGGAATCTG

AGTCAGAGACACCCTCTGAGGAGGAGGAGAGTTCCACCCCTGAATCAGAAGAATCGGAATCCAC

AGAGTCAGAAGGAGAAAAAGCAAGGAAAAACATTGTGCTTGCAAGAAGAAGGCCCATGGTTGAG

GAGGTCAAGGAAGTCAAGGGTAGGAAAGAGGAGCCACAAGAAGAACAAAAAGAACCTAAGATGG

AAGAAGAAGAACACTCAGAAGAAGAAGAAAGTGGACCAGCCCCTGTGGAAGAAAGTACAGACCC

TGAAGCTCAAGATATCCCTGAAGAGGGCAGTGCAGAATCAGCTTCGGTGGAAGGAGGTGTGGAA

AGTGAGGAGGAATCAGAATCAGGTAGTAGTAGCAGTAGTAGCGAAAGTCAGTCTGGAGGTCCAT

GGGGCTATCAGGTACCAGCGTATGACAGAAGCAAGAATGCAAACCAAAAGAAGTCGCCAGGAGC

AAACTCTGAAGGTTACAACACAGCACTTTGA
```

An exemplary nucleic acid sequence encoding a mini-PCDH15 lacking EC4, EC7 and EC8 (V1) is set forth in SEQ ID NO: 78 (mini-PCDH15 V1: includes EC1-EC2-EC3-EC5-EC6-EC9-EC10-EC11-MAD12-TM-cyto CD3):

```
                                              (SEQ ID NO: 78)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC
```

-continued

```
CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAACGCCAACCTTCCCTGAAATATCCTATG

ATGTGTATGTTTATACAGACATGAGACCTGGGGACAGTGTCATACAGCTCACTGCAGTCGACGC

AGACGAAGGGTCAAATGGGGAGATCACATATGAAATCCTTGTTGGGGCTCAGGGAGACTTCATC

ATCAATAAAACAACAGGGCTTATCACCATCGCTCCAGGGGTGGAAATGATAGTCGGGCGGACTT

ACGCACTCACGGTCCAAGCAGCGGATAATGCTCCTCCTGCAGAGCGAAGGAACTCCATCTGCAC

TGTGTATATTGAAGTGCTTCCACCAAATAATCAAAGCCCTCCTCGCTTCCCACAGCTGATGTAT

AGCCTTGAAATTAGTGAAGCCATGAGGGTTGGTGCTGTTTTATTAAATCTACAGGCAACTGATC

GAGAGGGAGACTCAATAACATATGCCATTGAGAATGGAGATCCTCAGAGAGTTTTTAATCTTTC

AGAAACCACGGGGATTCTAACCTTAGGGAAAGCACTGGACAGGGAAAGCACTGATCGCTACATT

CTGATCATCACAGCTTCAGATGGCAGGCCAGATGGGACCTCAACTGCCACAGTAAACATAGTGG

TGACAGATGTCAATGACAATCCTCCTGTCTTTAGTAAACGAATATACAAAGGGATGGTGGCTCC

GGATGCAGTCAAGGGTACACCTATCACAACAGTTTATGCTGAAGATGCAGACCCTCCTGGATTA

CCTGCAAGTCGTGTGAGGTATAGAGTAGATGATGTACAGTTTCCTTACCCTGCCAGTATTTTTG

AAGTGGAAGAAGATTCTGGAAGAGTAATAACACGAGTCAATCTTAATGAAGAACCTACAACAAT

TTTTAAGTTGGTGGTGGTTGCTTTTGATGATGGGGAGCCTGTGATGTCCAGCAGTGCCACAGTG

AAGATTCTTGTCTTACATCCTGGTGAGATCCCACGCTTCACACAGGAGGAATATAGACCTCCTC

CAGTAAGTGAACTTGCCACCAAAGGGACCATGGTTGGTGTAATTTCTGCTGCTGCCATTAATCA

AAGTATTGTGTACTCCATTGTTTCAGGAAATGAAGAAGATACATTTGGAATTAATAACATCACA

GGTGTTATCTATGTGAATGGACCTCTGGATTATGAGACCAGGACAAGCTATGTACTTCGAGTCC

AAGCTGATTCCCTGGAAGTGGTCCTTGCCAATCTCCGAGTTCCTTCAAAAAGCAATACAGCTAA

AGTATACATTGAGATTCAGGATGAAAATAATCATCCCCCAGTGTTTCAGAAAAAATTCTACATC

GGAGGTGTATCTGAAGATGCAAGAATGTTTACTTCTGTACTCAGAGTGAAGGCTACTGATAAAG

ATACTGGCAATTATAGTGTCATGGCCTACAGACTCATAATACCACCAATTAAAGAGGGAAAAGA

AGGATTTGTAGTGGAAACATATACAGGGCTTATCAAAACTGCTATGCTCTTCCATAATATGAGG

AGATCCTACTTCAAGTTTCAAGTTATTGCAACTGACGACTATGGGAAGGGACTGAGCGGCAAAG

CCGATGTACTCGTCTCCGTGGTCAATCAGCTGGATATGCAAGTCATTGTTTCCAATGTGCCTCC

TACTCTAGTGGAAAAAAAGATAGAAGATCTTACAGAGATCTTGGATCGCTATGTTCAGGAACAA

ATTCCTGGTGCCAAGGTCGTAGTGGAGTCCATTGGAGCTCGCCGGCATGGAGATGCCTTTTCCC

TAGAAGATTACACCAAATGTGACTTGACTGTCTATGCAATTGACCCCCAAACCAACAGAGCCAT
```

-continued

```
CGATAGAAATGAGCTTTTTAAATTTTTGGATGGCAAACTACTTGATATCAATAAAGACTTTCAG

CCGTATTATGGGGAAGGAGGACGCATTCTGGAGATCCGGACTCCAGAGGCAGTGACCAGCATTA

AAAAGAGAGGAGAAAGTCTAGGATACACAGAAGGGGCCTTGTTGGCTCTGGCCTTCATCATCAT

CCTCTGCTGCATTCCTGCCATCTTGGTGGTTTTGGTCAGCTACAGACAGTTTAAAGTACGTCAA

GCTGAGTGTACAAAGACTGCACGAATTCAGGCCGCATTACCCGCGGCTAAACCAGCAGTGCCGG

CTCCTGCACCAGTGGCAGCGCCCCCGCCGCCGCCGCCGCCTCCGCCAGGTGCGCATCTCTATGA

AGAACTTGGAGACAGCTCAATGCATAAGTATGAAATGCCTCAATATGGGAGTCGCCGTCGATTG

TTACCACCAGCTGGACAGGAGGAATATGGTGAGGTGGTTGGTGAAGCTGAGGAAGAATATGAGG

AGGAAGAGTGGGCAAGAAAAAGAATGATCAAGTTAGTTGTTGATCGAGAGTATGAAACCAGCTC

AACTGGAGAAGACAGTGCTCCTGAATGTCAGAGAAACCGTCTTCACCATCCTAGTATCCACAGT

AATATCAACGGCAATATATATATTGCACAGAATGGTTCTGTGGTGAGAACCCGCCGTGCCTGCC

TCACGGACAACTTAAAAGTTGCTTCCCCTGTTCGACTGGGAGGGCCCTTTAAGAAACTAGACAA

GTTGGCAGTGACACATGAGGAGAATGTACCTCTGAACACATTATCAAAGGGGCCATTTTCTACT

GAAAAAATGAATGCAAGACCAACTCTGGTTACATTTGCCCCTTGCCCTGTGGGGACTGACAATA

CAGCGGTGAAGCCACTAAGGAACAGGCTGAAAAGCACAGTTGAACAGGAGTCCATGATTGACAG

TAAGAACATCAAGGAGGCTTTGGAATTTCATAGTGACCACACACAGTCTGATGATGAAGAGCTT

TGGATGGGCCCCTGGAACAACCTCCATATACCAATGACAAAACTGTGA
```

In some examples, the mini-PCDH15 lacks EC5, EC6 and EC7 domain. In some embodiments, the mini-PCDH15 includes EC1-EC2-EC3-EC4-EC8-EC9-EC10-EC11 of SEQ ID NO: 1, 53, 55, or 57. In one example, the mini-PCDH15 comprises an amino acid sequence at least 60%, 70%, 75%, 80%, 85%, 90%, 91%, 92%, 93%, 94%, 95%, 96%, 97%, 98%, 99% or 100% identical to SEQ ID NO: 33, 79 or 80. In some embodiments, the nucleic acid encoding the mini-PCDH15 lacking EC5, EC6 and EC7 is at least 60%, 70%, 75%, 80%, 85%, 90%, 91%, 92%, 93%, 94%, 95%, 96%, 97%, 98%, 99% or 100% identical to SEQ ID NO: 34, 81 or 82.

An exemplary amino acid sequence of a mini-PCDH15 lacking EC5, EC6 and EC7 (V2) is set forth in SEQ ID NO: 33 (mini-PCDH15 V2: includes EC1-EC2-EC3-EC4-EC8-EC9-EC10-EC1-MAD12-TM-cyto CD1; different domains alternating in bold and regular font):

```
                                    (SEQ ID NO: 33)
MFRQFYLWTCLASGIILGSLFEICLGQYDDDWQYEDCKLARGGPPATIVA

IDEESRNGTILVDNMLIKGTAGGPDPTIELSLKDNVDYWVLMDPVKQMLF

LNSTGRVLDRDPPMNIHSIVVQVQCINKKVGTIIYHEVRIVVRDRNDNSP

TFKHESYYATVNELTPVGTTIFTGFSGDNGATDIDDGPNGQIEYVIQYNP

DDPTSNDTFEIPLMLTGNIVLRKRLNYEDKTRYFVIIQANDRAQNLNERR

TTTTTLTVDVLDGDDLGPMFLPCVLVPNTRDCRPLTYQAAIPELRTPEEL

NPIIVTPPIQAIDQDRNIQPPSDRPGILYSILVGTPEDYPRFFHMHPRTA

ELSLLEPVNRDFHQKFDLVIKAEQDNGHPLPAFAGLHIEILDENNQSPYF

TMPSYQGYILESAPVGATISDSLNLTSPLRIVALDKDIEDTKDPELHLFL

NDYTSVFTVTQTGITRYLTLLQPVDREEQQTYTFSITAFDGVQESEPVIV

NIQVMDANDNSPVFTNSTYTVLVEENLPAGTTILQIEAKDVDLGANVSYR
```

-continued

```
IRSPEVKHFFALHPFTGELSLLRSLDYEAFPDQEASITFLVEAFDIYGTM

PPGIATVTVIVKDMNDYPPVFSKRIYKGMVAPDAVKGTPITTVYAEDADP

PGLPASRVRYRVDDVQFPYPASIFEVEEDSGRVITRVNLNEEPTTIFKLV

VVAFDDGEPVMSSSATVKILVLHPGEIPRFTQEEYRPPPVSELATKGTMV

GVISAAAINQSIVYSIVSGNEEDTFGINNITGVIYVNGPLDYETRTSYVL

RVQADSLEVVLANLRVPSKSNTAKVYIEIQDENNHPPVFQKKFYIGGVSE

DARMFTSVLRVKATDKDTGNYSVMAYRLIIPPIKEGKEGFVVETYTGLIK

TAMLFHNMRRSYFKFQVIATDDYGKGLSGKADVLVSVVNQLDMQVIVSNV

PPTLVEKKIEDLTEILDRYVQEQIPGAKVVVESIGARRHGDAFSLEDYTK

CDLTVYAIDPQTNRAIDRNELFKFLDGKLLDINKDFQPYYGEGGRILEIR

TPEAVTSIKKRGESLGYTEGALLALAFIIILCCIPAILVVLVSYRQFKVR

QAECTKTARIQAALPAAKPAVPAPAPVAAPPPPPPPPPGAHLYEELGDSS

MHNLFLLYHFQQSRGNNSVSEDRKHQQVVMPFSSNTIEAHKSAHVDGSLK

SNKLKSARKFTFLSDEDDLSAHNPLYKENISQVSTNSDISQRTDFVDPFS

PKIQAKSKSLRGPREKIQRLWSQSVSLPRRLMRKVPNRPEIIDLQQWQGT

RQKAENENTGICTNKRGSSNPLLTTEEANLTEKEEIRQGETLMIEGTEQL

KSLSSDSSFCFPRPHFSFSTLPTVSRTVELKSEPNVISSPAECSLELSPS

RPCVLHSSLSRRETPICMLPIETERNIFENFAHPPNISPSACPLPPPPPI

SPPSPPPAPAPLAPPPDISPFSLFCPPPSPPSIPLPLPPPTFFPLSVSTS

GPPTPPLLPPFPTPLPPPPPSIPCPPPPSASFLSTECVCITGVKCTTNLM
```

-continued

PAEKIKSSMTQLSTTTVCKTDPQREPKGILRHVKNLAELEKSVANMYSQI

EKNYLRTNVSELQTMCPSEVTNMEITSEQNKGSLNNIVEGTEKQSHSQST

SL

An exemplary amino acid sequence of a mini-PCDH15 lacking EC5, EC6 and EC7 (V2) is set forth in SEQ ID NO: 79 (mini-PCDH15 V2: includes EC1-EC2-EC3-EC4-EC8-EC9-EC10-EC1-MAD12-TM-cyto CD2; different domains alternating in bold and regular font):

(SEQ ID NO: 79)

MFRQFYLWTCLASGIILGSLFEICLGQYDDDWQYEDCKLARGGPPATIVA

IDEESRNGTILVDNMLIKGTAGGPDPTIELSLKDNVDYWVLMDPVKQMLF

LNSTGRVLDRDPPMNIHSIVVQVQCINKKVGTIIYHEVRIVVRDRNDNSP

TFKHESYYATVNELTPVGTTIFTGFSGDNGATDIDDGPNGQIEYVIQYNP

DDPTSNDTFEIPLMLTGNIVLRKRLNYEDKTRYFVIIQANDRAQNLNERR

TTTTTLTVDVLDGDDLGPMFLPCVLVPNTRDCRPLTYQAAIPELRTPEEL

NPIIVTPPIQAIDQDRNIQPPSDRPGILYSILVGTPEDYPRFFHMHPRTA

ELSLLEPVNRDFHQKFDLVIKAEQDNGHPLPAFAGLHIEILDENNQSPYF

TMPSYQGYILESAPVGATISDSLNLTSPLRIVALDKDIEDTKDPELHLFL

NDYTSVFTVTQTGITRYLTLLQPVDREEQQTYTFSITAFDGVQESEPVIV

NIQVMDANDNSPVFTNSTYTVLVEENLPAGTTILQIEAKDVDLGANVSYR

IRSPEVKHFFALHPFTGELSLLRSLDYEAFPDQEASITFLVEAFDIYGTM

PPGIATVTVIVKDMNDYPPVFSKRIYKGMVAPDAVKGTPITTVYAEDADP

PGLPASRVRYRVDDVQFPYPASIFEVEEDSGRVITRVNLNEEPTTIFKLV

VVAFDDGEPVMSSSATVKILVLHPGEIPRFTQEEYRPPPVSELATKGTMV

GVISAAAINQSIVYSIVSGNEEDTFGINNITGVIYVNGPLDYETRTSYVL

RVQADSLEVVLANLRVPSKSNTAKVYIEIQDENNHPPVFQKKFYIGGVSE

DARMFTSVLRVKATDKDTGNYSVMAYRLIIPPIKEGKEGFVVETYTGLIK

TAMLFHNMRRSYFKFQVIATDDYGKGLSGKADVLVSVVNQLDMQVIVSNV

PPTLVEKKIEDLTEILDRYVQEQIPGAKVVVESIGARRHGDAFSLEDYTK

CDLTVYAIDPQTNRAIDRNELFKFLDGKLLDINKDFQPYYGEGGRILEIR

TPEAVTSIKKRGESLGYTEGALLALAFIIILCCIPAILVVLVSYRQFKVR

QAECTKTARIQAALPAAKPAVPAPAPVAAPPPPPPPPPGAHLYEELGDSS

MHKYEMPQYGSRRRLLPPAGQEEYGEVVGEAEEEYEEEEEPKKIKKPKV

EIREPSEEEEVVVTIEKPPAAEPTYTTWKRARIETMIFKKVRGLADKRGI

VDLEGEEWQRRLEEEDKDYLKLTLDQEEATESTVESEEESSSDYTEYSEE

ESEFSESETTEEESESETPSEEEESSTPESEESESTESEGEKARKNIVLA

RRRPMVEEVKEVKGRKEEPQEEQKEPKMEEEEHSEEEESGPAPVEESTDP

-continued

EAQDIPEEGSAESASVEGGVESEEEESESGSSSSSSESQSGGPWGYQVPAY

DRSKNANQKKSPGANSEGYNTAL

An exemplary amino acid sequence of a mini-PCDH15 lacking EC5, EC6 and EC7 (V2) is set forth in SEQ ID NO: 80 (mini-PCDH15 V2: includes EC1-EC2-EC3-EC4-EC8-EC9-EC10-EC11-MAD12-TM-cyto CD3; different domains alternating in bold and regular font):

(SEQ ID NO: 80)

MFRQFYLWTCLASGIILGSLFEICLGQYDDDWQYEDCKLARGGPPATIVA

IDEESRNGTILVDNMLIKGTAGGPDPTIELSLKDNVDYWVLMDPVKQMLF

LNSTGRVLDRDPPMNIHSIVVQVQCINKKVGTIIYHEVRIVVRDRNDNSP

TFKHESYYATVNELTPVGTTIFTGFSGDNGATDIDDGPNGQIEYVIQYNP

DDPTSNDTFEIPLMLTGNIVLRKRLNYEDKTRYFVIIQANDRAQNLNERR

TTTTTLTVDVLDGDDLGPMFLPCVINPNTRDCRPLTYQAAIPELRTPEEL

NPIIVTPPIQAIDQDRNIQPPSDRPGILYSILVGTPEDYPRFFHMHPRTA

ELSLLEPVNRDFHQKFDLVIKAEQDNGHPLPAFAGLHIEILDENNQSPYF

TMPSYQGYILESAPVGATISDSLNLTSPLRIVALDKDIEDTKDPELHLFL

NDYTSVFTVTQTGITRYLTLLQPVDREEQQTYTFSITAFDGVQESEPVIV

NIQVMDANDNSPVFTNSTYTVLVEENLPAGTTILQIEAKDVDLGANVSYR

IRSPEVKHFFALHPFTGELSLLRSLDYEAFPDQEASITFLVEAFDIYGTM

PPGIATVTVIVKDMNDYPPVFSKRIYKGMVAPDAVKGTPITTVYAEDADP

PGLPASRVRYRVDDVQFPYPASIFEVEEDSGRVITRVNLNEEPTTIFKLV

VVAFDDGEPVMSSSATVKILVLHPGEIPRFTQEEYRPPPVSELATKGTMV

GVISAAAINQSIVYSIVSGNEEDTFGINNITGVIYVNGPLDYETRTSYVL

RVQADSLEVVLANLRVPSKSNTAKVYIEIQDENNHPPVFQKKFYIGGVSE

DARMFTSVLRVKATDKDTGNYSVMAYRLIIPPIKEGKEGFVVETYTGLIK

TAMLFHNMRRSYFKFQVIATDDYGKGLSGKADVLVSVVNQLDMQVIVSNV

PPTLVEKKIEDLTEILDRYVQEQIPGAKVVVESIGARRHGDAFSLEDYTK

CDLTVYAIDPQTNRAIDRNELFKFLDGKLLDINKDFQPYYGEGGRILEIR

TPEAVTSIKKRGESLGYTEGALLALAFIIILCCIPAILVVLVSYRQFKVR

QAECTKTARIQAALPAAKPAVPAPAPVAAPPPPPPPPPGAHLYEELGDSS

MHKYEMPQYGSRRRLLPPAGQEEYGEVVGEAEEEYEEEEWARKRMIKLVV

DREYETSSTGEDSAPECQRNRLHHPSIHSNINGNIYIAQNGSVVRTRRAC

LTDNLKVASPVRLGGPFKKLDKLAVTHEENVPLNTLSKGPFSTEKMNARP

TLVTFAPCPVGTDNTAVKPLRNRLKSTVEQESMIDSKNIKEALEFHSDHT

QSDDEELWMGPWNNLHIPMTKL

An exemplary nucleic acid sequence encoding a mini-PCDH15 lacking EC5, EC6 and EC7 (V2) is set forth in SEQ ID NO: 34 (mini-PCDH15 V2: includes EC1-EC2-EC3-EC4-EC8-EC9-EC10-EC11-MAD12-TM-cyto CD1):

(SEQ ID NO: 34)

ATGTTTCGACAGTTTTATCTCTGGACATGTTTAGCTTCAGGGATCATCCTGGGCTCTCTTTG

AAATCTGCTTGGGCCAGTATGATGATGACTGGCAATATGAGGATTGCAAACTAGCTAGGGGAGG

-continued

```
ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAAGTCCATATTTTACAATGCCCAGTTATC

AAGGCTATATCCTGGAATCTGCCCCAGTGGGAGCAACCATTTCGGACAGTCTCAATTTGACTTC

ACCTTTAAGAATAGTAGCTCTGGACAAGGACATAGAAGATACAAAAGACCCAGAGCTTCACCTT

TTTCTGAATGACTACACCTCAGTCTTCACCGTCACACAGACTGGTATTACTCGCTACCTCACCT

TACTTCAACCAGTGGACAGGGAAGAACAGCAAACTTACACCTTTTCGATAACAGCATTTGATGG

TGTACAAGAAAGTGAGCCAGTCATCGTCAATATTCAAGTGATGGATGCAAATGATAACAGTCCT

GTGTTCACCAATTCAACATACACTGTCCTTGTTGAAGAGAATTTGCCAGCTGGGACTACCATCC

TTCAAATAGAGGCCAAAGATGTCGACCTTGGAGCAAATGTGTCTTACCGGATAAGAAGCCCAGA

AGTGAAGCACTTTTTTGCACTACATCCATTTACAGGAGAACTATCGCTTTTAAGGAGTTTAGAT

TATGAGGCATTTCCAGACCAAGAAGCAAGTATCACTTTTCTGGTAGAGGCCTTTGATATTTATG

GAACAATGCCACCTGGTATTGCTACTGTCACAGTGATTGTAAAGGATATGAATGATTATCCTCC

TGTCTTTAGTAAACGAATATACAAAGGGATGGTGGCTCCGGATGCAGTCAAGGGTACACCTATC

ACAACAGTTTATGCTGAAGATGCAGACCCTCCTGGATTACCTGCAAGTCGTGTGAGGTATAGAG

TAGATGATGTACAGTTTCCTTACCCTGCCAGTATTTTTGAAGTGGAAGAAGATTCTGGAAGAGT

AATAACACGAGTCAATCTTAATGAAGAACCTACAACAATTTTTAAGTTGGTGGTGGTTGCTTTT

GATGATGGGGAGCCTGTGATGTCCAGCAGTGCCACAGTGAAGATTCTTGTCTTACATCCTGGTG

AGATCCCACGCTTCACACAGGAGGAATATAGACCTCCTCCAGTAAGTGAACTTGCCACCAAAGG

GACCATGGTTGGTGTAATTTCTGCTGCTGCCATTAATCAAAGTATTGTGTACTCCATTGTTTCA

GGAAATGAAGAAGATACATTTGGAATTAATAACATCACAGGTGTTATCTATGTGAATGGACCTC

TGGATTATGAGACCAGGACAAGCTATGTACTTCGAGTCCAAGCTGATTCCCTGGAAGTGGTCCT

TGCCAATCTCCGAGTTCCTTCAAAAAGCAATACAGCTAAAGTATACATTGAGATTCAGGATGAA

AATAATCATCCCCCAGTGTTTCAGAAAAAATTCTACATCGGAGGTGTATCTGAAGATGCAAGAA

TGTTTACTTCTGTACTCAGAGTGAAGGCTACTGATAAAGATACTGGCAATTATAGTGTCATGGC

CTACAGACTCATAATACCACCAATTAAAGAGGGAAAAGAAGGATTTGTAGTGGAAACATATACA

GGGCTTATCAAAACTGCTATGCTCTTCCATAATATGAGGAGATCCTACTTCAAGTTTCAAGTTA
```

-continued

```
TTGCAACTGACGACTATGGGAAGGGACTGAGCGGCAAAGCCGATGTACTCGTCTCCGTGGTCAA

TCAGCTGGATATGCAAGTCATTGTTTCCAATGTGCCTCCTACTCTAGTGGAAAAAAAGATAGAA

GATCTTACAGAGATCTTGGATCGCTATGTTCAGGAACAAATTCCTGGTGCCAAGGTCGTAGTGG

AGTCCATTGGAGCTCGCCGGCATGGAGATGCCTTTTCCCTAGAAGATTACACCAAATGTGACTT

GACTGTCTATGCAATTGACCCCCAAACCAACAGAGCCATCGATAGAAATGAGCTTTTTAAATTT

TTGGATGGCAAACTACTTGATATCAATAAAGACTTTCAGCCGTATTATGGGGAAGGAGGACGCA

TTCTGGAGATCCGGACTCCAGAGGCAGTGACCAGCATTAAAAAGAGGAGAAAGTCTAGGATA

CACAGAAGGGGCCTTGTTGGCTCTGGCCTTCATCATCATCCTCTGCTGCATTCCTGCCATCTTG

GTGGTTTTGGTCAGCTACAGACAGTTTAAAGTACGTCAAGCTGAGTGTACAAAGACTGCACGAA

TTCAGGCCGCATTACCCGCGGCTAAACCAGCAGTGCCGGCTCCTGCACCAGTGGCAGCGCCCCC

GCCGCCGCCGCCGCCTCCGCCAGGTGCGCATCTCTATGAAGAACTTGGAGACAGCTCAATGCAT

AATCTTTTCCTTCTCTACCATTTTCAACAAAGCAGGGGAAATAACTCAGTCTCAGAAGACAGGA

AACATCAACAAGTTGTGATGCCCTTTTCTTCCAATACTATTGAGGCTCACAAGTCAGCTCATGT

AGACGGATCACTTAAGAGCAACAAACTGAAGTCTGCAAGAAAATTCACATTTCTATCTGATGAG

GATGACTTAAGTGCCCATAATCCCCTTTATAAGGAAAACATAAGTCAAGTATCAACAAATTCAG

ACATTTCACAGAGAACAGATTTTGTAGACCCATTTTCACCCAAAATACAAGCCAAGAGTAAGTC

TCTGAGGGGCCCAAGAGAAAAGATTCAGAGGCTGTGGAGTCAGTCAGTCAGCTTACCCAGGAGG

CTGATGAGGAAAGTTCCAAATAGACCAGAGATCATAGATCTGCAGCAGTGGCAAGGCACCAGGC

AGAAAGCTGAAAATGAAAACACTGGAATCTGTACAAACAAAAGAGGTAGCAGCAATCCATTGCT

TACAACTGAAGAGGCAAATTTGACAGAGAAAGAGGAAATAAGGCAAGGTGAAACACTGATGATA

GAAGGAACAGAACAGTTGAAATCTCTCTCTTCAGACTCTTCATTTTGCTTTCCCAGGCCTCACT

TCTCATTCTCCACTTTGCCAACTGTTTCAAGAACTGTGGAACTCAAATCAGAACCTAATGTCAT

CAGTTCTCCTGCTGAGTGTTCCTTGGAACTTTCTCCTTCAAGGCCTTGTGTTTTACATTCTTCA

CTCTCTAGGAGAGAGACACCTATTTGTATGTTACCTATTGAAACCGAAAGAAATATTTTTGAAA

ATTTTGCCCATCCACCAAACATCTCTCCTTCTGCCTGTCCCCTTCCCCCTCCTCCTCCTATTTC

TCCTCCTTCTCCTCCTCCTGCTCCTGCTCCTCTTGCTCCTCCTCCTGACATTTCTCCTTTTTCT

CTTTTTTGTCCTCCTCCCTCTCCTCCTTCTATCCCTCTTCCTCTTCCTCCTCCTACATTTTTTC

CACTTTCCGTTTCAACGTCTGGTCCCCCAACACCACCTCTTCTACCTCCATTTCCAACTCCTCT

TCCTCCACCACCTCCTTCTATTCCTTGCCCTCCACCTCCTTCAGCTTCATTTCTGTCCACAGAG

TGTGTCTGTATAACAGGTGTTAAATGCACGACCAACTTGATGCCTGCCGAGAAAATTAAGTCCT

CTATGACACAGCTATCAACAACGACAGTGTGTAAAACAGACCCTCAGAGAGAACCAAAAGGCAT

CCTCAGACACGTTAAAAACTTAGCAGAACTTGAAAAATCAGTAGCTAACATGTACAGTCAAATA

GAAAAAAACTATCTACGCACAAATGTTTCAGAACTTCAAACTATGTGCCCTTCAGAAGTAACAA

ATATGGAAATCACATCTGAACAAAACAAGGGGAGTTTGAACAATATTGTCGAGGGAACTGAAAA

ACAATCTCACAGTCAATCTACTTCACTGTAA
```

An exemplary nucleic acid sequence encoding a mini-PCDH15 lacking EC5, EC6 and EC7 (V2) is set forth in SEQ ID NO: 81 (mini-PCDH15 V2: includes EC1-EC2-EC3-EC4-EC8-EC9-EC10-EC11-MAD12-TM-cyto CD2):

(SEQ ID NO: 81)

```
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG
```

-continued

```
ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAAGTCCATATTTTACAATGCCCAGTTATC

AAGGCTATATCCTGGAATCTGCCCCAGTGGGAGCAACCATTTCGGACAGTCTCAATTTGACTTC

ACCTTTAAGAATAGTAGCTCTGGACAAGGACATAGAAGATACAAAAGACCCAGAGCTTCACCTT

TTTCTGAATGACTACACCTCAGTCTTCACCGTCACACAGACTGGTATTACTCGCTACCTCACCT

TACTTCAACCAGTGGACAGGGAAGAACAGCAAACTTACACCTTTTCGATAACAGCATTTGATGG

TGTACAAGAAAGTGAGCCAGTCATCGTCAATATTCAAGTGATGGATGCAAATGATAACAGTCCT

GTGTTCACCAATTCAACATACACTGTCCTTGTTGAAGAGAATTTGCCAGCTGGGACTACCATCC

TTCAAATAGAGGCCAAAGATGTCGACCTTGGAGCAAATGTGTCTTACCGGATAAGAAGCCCAGA

AGTGAAGCACTTTTTTGCACTACATCCATTTACAGGAGAACTATCGCTTTTAAGGAGTTTAGAT

TATGAGGCATTTCCAGACCAAGAAGCAAGTATCACTTTTCTGGTAGAGGCCTTTGATATTTATG

GAACAATGCCACCTGGTATTGCTACTGTCACAGTGATTGTAAAGGATATGAATGATTATCCTCC

TGTCTTTAGTAAACGAATATACAAAGGGATGGTGGCTCCGGATGCAGTCAAGGGTACACCTATC

ACAACAGTTTATGCTGAAGATGCAGACCCTCCTGGATTACCTGCAAGTCGTGTGAGGTATAGAG

TAGATGATGTACAGTTTCCTTACCCTGCCAGTATTTTTGAAGTGGAAGAAGATTCTGGAAGAGT

AATAACACGAGTCAATCTTAATGAAGAACCTACAACAATTTTTAAGTTGGTGGTGGTTGCTTTT

GATGATGGGGAGCCTGTGATGTCCAGCAGTGCCACAGTGAAGATTCTTGTCTTACATCCTGGTG

AGATCCCACGCTTCACACAGGAGGAATATAGACCTCCTCCAGTAAGTGAACTTGCCACCAAAGG

GACCATGGTTGGTGTAATTTCTGCTGCTGCCATTAATCAAAGTATTGTGTACTCCATTGTTTCA

GGAAATGAAGAAGATACATTTGGAATTAATAACATCACAGGTGTTATCTATGTGAATGGACCTC

TGGATTATGAGACCAGGACAAGCTATGTACTTCGAGTCCAAGCTGATTCCCTGGAAGTGGTCCT

TGCCAATCTCCGAGTTCCTTCAAAAAGCAATACAGCTAAAGTATACATTGAGATTCAGGATGAA

AATAATCATCCCCCAGTGTTTCAGAAAAAATTCTACATCGGAGGTGTATCTGAAGATGCAAGAA

TGTTTACTTCTGTACTCAGAGTGAAGGCTACTGATAAAGATACTGGCAATTATAGTGTCATGGC

CTACAGACTCATAATACCACCAATTAAAGAGGGAAAAGAAGGATTTGTAGTGGAAACATATACA
```

-continued
GGGCTTATCAAAACTGCTATGCTCTTCCATAATATGAGGAGATCCTACTTCAAGTTTCAAGTTA

TTGCAACTGACGACTATGGGAAGGGACTGAGCGGCAAAGCCGATGTACTCGTCTCCGTGGTCAA

TCAGCTGGATATGCAAGTCATTGTTTCCAATGTGCCTCCTACTCTAGTGGAAAAAAAGATAGAA

GATCTTACAGAGATCTTGGATCGCTATGTTCAGGAACAAATTCCTGGTGCCAAGGTCGTAGTGG

AGTCCATTGGAGCTCGCCGGCATGGAGATGCCTTTTCCCTAGAAGATTACACCAAATGTGACTT

GACTGTCTATGCAATTGACCCCCAAACCAACAGAGCCATCGATAGAAATGAGCTTTTTAAATTT

TTGGATGGCAAACTACTTGATATCAATAAAGACTTTCAGCCGTATTATGGGGAAGGAGGACGCA

TTCTGGAGATCCGGACTCCAGAGGCAGTGACCAGCATTAAAAAGAGAGGAGAAAGTCTAGGATA

CACAGAAGGGGCCTTGTTGGCTCTGGCCTTCATCATCATCCTCTGCTGCATTCCTGCCATCTTG

GTGGTTTTGGTCAGCTACAGACAGTTTAAAGTACGTCAAGCTGAGTGTACAAAGACTGCACGAA

TTCAGGCCGCATTACCCGCGGCTAAACCAGCAGTGCCGGCTCCTGCACCAGTGGCAGCGCCCCC

GCCGCCGCCGCCGCCTCCGCCAGGTGCGCATCTCTATGAAGAACTTGGAGACAGCTCAATGCAT

AAGTATGAAATGCCTCAATATGGGAGTCGCCGTCGATTGTTACCACCAGCTGGACAGGAGGAAT

ATGGTGAGGTGGTTGGTGAAGCTGAGGAAGAATATGAGGAGGAAGAGGAAGAGCCAAAGAAAAT

TAAAAAACCAAAGGTTGAAATTAGAGAGCCTAGTGAGGAGGAAGAAGTAGTTGTAACTATCGAA

AAACCACCAGCAGCTGAGCCTACATACACAACATGGAAGAGAGCCAGAATATTCCCCATGATTT

TTAAGAAAGTTAGAGGATTAGCTGATAAAAGAGGAATCGTTGACCTTGAGGGTGAAGAGTGGCA

GAGACGCCTTGAGGAAGAAGATAAAGATTATTTGAAACTCACTCTGGACCAAGAGGAAGCAACA

GAAAGCACTGTAGAATCAGAGGAGGAATCCTCCAGCGACTATACTGAATACAGTGAAGAAGAGT

CTGAGTTCAGTGAGTCTGAGACTACAGAAGAGGAATCTGAGTCAGAGACACCCTCTGAGGAGGA

GGAGAGTTCCACCCCTGAATCAGAAGAATCGGAATCCACAGAGTCAGAAGGAGAAAAAGCAAGG

AAAAACATTGTGCTTGCAAGAAGAAGGCCCATGGTTGAGGAGGTCAAGGAAGTCAAGGGTAGGA

AAGAGGAGCCACAAGAAGAACAAAAAGAACCTAAGATGGAAGAAGAAGAACACTCAGAAGAAGA

AGAAAGTGGACCAGCCCCTGTGGAAGAAAGTACAGACCCTGAAGCTCAAGATATCCCTGAAGAG

GGCAGTGCAGAATCAGCTTCGGTGGAAGGAGGTGTGGAAAGTGAGGAGGAATCAGAATCAGGTA

GTAGTAGCAGTAGTAGCGAAAGTCAGTCTGGAGGTCCATGGGGCTATCAGGTACCAGCGTATGA

CAGAAGCAAGAATGCAAACCAAAAGAAGTCGCCAGGAGCAAACTCTGAAGGTTACAACACAGCA

CTTTGA

An exemplary nucleic acid sequence encoding a mini-PCDH15 lacking EC5, EC6 and EC7 (V2) is set forth in SEQ ID NO: 82 (mini-PCDH15 V2: includes EC1-EC2-EC3-EC4-EC8-EC9-EC10-EC11-MAD12-TM-cyto CD3):

(SEQ ID NO: 82)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

-continued

```
GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAAGTCCATATTTTACAATGCCCAGTTATC

AAGGCTATATCCTGGAATCTGCCCCAGTGGGAGCAACCATTTCGGACAGTCTCAATTTGACTTC

ACCTTTAAGAATAGTAGCTCTGGACAAGGACATAGAAGATACAAAAGACCCAGAGCTTCACCTT

TTTCTGAATGACTACACCTCAGTCTTCACCGTCACACAGACTGGTATTACTCGCTACCTCACCT

TACTTCAACCAGTGGACAGGGAAGAACAGCAAACTTACACCTTTTCGATAACAGCATTTGATGG

TGTACAAGAAAGTGAGCCAGTCATCGTCAATATTCAAGTGATGGATGCAAATGATAACAGTCCT

GTGTTCACCAATTCAACATACACTGTCCTTGTTGAAGAGAATTTGCCAGCTGGGACTACCATCC

TTCAAATAGAGGCCAAAGATGTCGACCTTGGAGCAAATGTGTCTTACCGGATAAGAAGCCCAGA

AGTGAAGCACTTTTTTGCACTACATCCATTTACAGGAGAACTATCGCTTTTAAGGAGTTTAGAT

TATGAGGCATTTCCAGACCAAGAAGCAAGTATCACTTTTCTGGTAGAGGCCTTTGATATTTATG

GAACAATGCCACCTGGTATTGCTACTGTCACAGTGATTGTAAAGGATATGAATGATTATCCTCC

TGTCTTTAGTAAACGAATATACAAAGGGATGGTGGCTCCGGATGCAGTCAAGGGTACACCTATC

ACAACAGTTTATGCTGAAGATGCAGACCCTCCTGGATTACCTGCAAGTCGTGTGAGGTATAGAG

TAGATGATGTACAGTTTCCTTACCCTGCCAGTATTTTTGAAGTGGAAGAAGATTCTGGAAGAGT

AATAACACGAGTCAATCTTAATGAAGAACCTACAACAATTTTTAAGTTGGTGGTGGTTGCTTTT

GATGATGGGGAGCCTGTGATGTCCAGCAGTGCCACAGTGAAGATTCTTGTCTTACATCCTGGTG

AGATCCCACGCTTCACACAGGAGGAATATAGACCTCCTCCAGTAAGTGAACTTGCCACCAAAGG

GACCATGGTTGGTGTAATTTCTGCTGCTGCCATTAATCAAAGTATTGTGTACTCCATTGTTTCA

GGAAATGAAGAAGATACATTTGGAATTAATAACATCACAGGTGTTATCTATGTGAATGGACCTC

TGGATTATGAGACCAGGACAAGCTATGTACTTCGAGTCCAAGCTGATTCCCTGGAAGTGGTCCT

TGCCAATCTCCGAGTTCCTTCAAAAAGCAATACAGCTAAAGTATACATTGAGATTCAGGATGAA

AATAATCATCCCCCAGTGTTTCAGAAAAAATTCTACATCGGAGGTGTATCTGAAGATGCAAGAA

TGTTTACTTCTGTACTCAGAGTGAAGGCTACTGATAAAGATACTGGCAATTATAGTGTCATGGC

CTACAGACTCATAATACCACCAATTAAAGAGGGAAAAGAAGGATTTGTAGTGGAAACATATACA

GGGCTTATCAAAACTGCTATGCTCTTCCATAATATGAGGAGATCCTACTTCAAGTTTCAAGTTA

TTGCAACTGACGACTATGGGAAGGGACTGAGCGGCAAAGCCGATGTACTCGTCTCCGTGGTCAA

TCAGCTGGATATGCAAGTCATTGTTTCCAATGTGCCTCCTACTCTAGTGGAAAAAAAGATAGAA

GATCTTACAGAGATCTTGGATCGCTATGTTCAGGAACAAATTCCTGGTGCCAAGGTCGTAGTGG

AGTCCATTGGAGCTCGCCGGCATGGAGATGCCTTTTCCCTAGAAGATTACACCAAATGTGACTT

GACTGTCTATGCAATTGACCCCCAAACCAACAGAGCCATCGATAGAAATGAGCTTTTTAAATTT

TTGGATGGCAAACTACTTGATATCAATAAAGACTTTCAGCCGTATTATGGGGAAGGAGGACGCA

TTCTGGAGATCCGGACTCCAGAGGCAGTGACCAGCATTAAAAAGAGAGGAGAAAGTCTAGGATA
```

-continued

CACAGAAGGGGCCTTGTTGGCTCTGGCCTTCATCATCATCCTCTGCTGCATTCCTGCCATCTTG

GTGGTTTTGGTCAGCTACAGACAGTTTAAAGTACGTCAAGCTGAGTGTACAAAGACTGCACGAA

TTCAGGCCGCATTACCCGCGGCTAAACCAGCAGTGCCGGCTCCTGCACCAGTGGCAGCGCCCCC

GCCGCCGCCGCCGCCTCCGCCAGGTGCGCATCTCTATGAAGAACTTGGAGACAGCTCAATGCAT

AAGTATGAAATGCCTCAATATGGGAGTCGCCGTCGATTGTTACCACCAGCTGGACAGGAGGAAT

ATGGTGAGGTGGTTGGTGAAGCTGAGGAAGAATATGAGGAGGAAGAGTGGGCAAGAAAAAGAAT

GATCAAGTTAGTTGTTGATCGAGAGTATGAAACCAGCTCAACTGGAGAAGACAGTGCTCCTGAA

TGTCAGAGAAACCGTCTTCACCATCCTAGTATCCACAGTAATATCAACGGCAATATATATATTG

CACAGAATGGTTCTGTGGTGAGAACCCGCCGTGCCTGCCTCACGGACAACTTAAAAGTTGCTTC

CCCTGTTCGACTGGGAGGGCCCTTTAAGAAACTAGACAAGTTGGCAGTGACACATGAGGAGAAT

GTACCTCTGAACACATTATCAAAGGGGCCATTTTCTACTGAAAAAATGAATGCAAGACCAACTC

TGGTTACATTTGCCCCTTGCCCTGTGGGGACTGACAATACAGCGGTGAAGCCACTAAGGAACAG

GCTGAAAAGCACAGTTGAACAGGAGTCCATGATTGACAGTAAGAACATCAAGGAGGCTTTGGAA

TTTCATAGTGACCACACACAGTCTGATGATGAAGAGCTTTGGATGGGCCCCTGGAACAACCTCC

ATATACCAATGACAAAACTGTGA

In some embodiments, the mini-PCDH15 has 4 EC domains less than the full-length PCDH15. In some examples, the mini-PCDH15 lacks EC4, EC5, EC6 and EC7 domain. In some embodiments, the mini-PCDH15 includes EC1-EC2-EC3-EC8-EC9-EC10-EC11 of SEQ ID NO: 1, 53, 55, or 57. In one example, the mini-PCDH15 comprises an amino acid sequence at least 60%, 70%, 75%, 80%, 85%, 90%, 91%, 92%, 93%, 94%, 95%, 96%, 97%, 98%, 99% or 100% identical to SEQ ID NO: 35, 83, or 84. In some embodiments, the nucleic acid encoding the mini-PCDH15 lacking EC4, EC5, EC6 and EC7 is at least 60%, 70%, 75%, 80%, 85%, 90%, 91%, 92%, 93%, 94%, 95%, 96%, 97%, 98%, 99% or 100% identical to SEQ ID NO: 36, 85, or 86.

(SEQ ID NO: 35)
MFRQFYLWTCLASGIILGSLFEICLGQYDDDWQYEDCKLARGGPPATIVA

IDEESRNGTILVDNMLIKGTAGGPDPTIELSLKDNVDYWVLMDPVKQMLF

LNSTGRVLDRDPPMNIHSIVVQVQCINKKVGTIIYHEVRIVVRDRNDNSP

TFKHESYYATVNELTPVGTTIFTGFSGDNGATDIDDGPNGQIEYVIQYNP

DDPTSNDTFEIPLMLTGNIVLRKRLNYEDKTRYFVIIQANDRAQNLNERR

TTTTTLTVDVLDGDDLGPMFLPCVLVPNTRDCRPLTYQAAIPELRTPEEL

NPIIVTPPIQAIDQDRNIQPPSDRPGILYSILVGTPEDYPRFFHMHPRTA

ELSLLEPVNRDFHQKFDLVIKAEQDNGHPLPAFAGLHIEILDENNQSPVF

TNSTYTVLVEENLPAGTTILQIEAKDVDLGANVSYRIRSPEVKHFFALHP

FTGELSLLRSLDYEAFPDQEASITFLVEAFDIYGTMPPGIATVTVIVKDM

NDYPPVFSKRIYKGMVAPDAVKGTPITTVYAEDADPPGLPASRVRYRVDD

VQFPYPASIFEVEEDSGRVITRVNLNEEPTTIFKLVVVAFDDGEPVMSSS

ATVKILVLHPGEIPRFTQEEYRPPPVSELATKGTMVGVISAAAINQSIVY

SIVSGNEEDTFGINNITGVIYVNGPLDYETRTSYVLRVQADSLEVVLANL

RVPSKSNTAKVYIEIQDENNHPPVFQKKFYIGGVSEDARMFTSVLRVKAT

-continued

DKDTGNYSVMAYRLIIPPIKEGKEGFVVETYTGLIKTAMLFHNMRRSYFK

FQVIATDDYGKGLSGKADVLVSVVNQLDMQVIVSNVPPTLVEKKIEDLTE

ILDRYVQEQIPGAKVVVESIGARRHGDAFSLEDYTKCDLTVYAIDPQTNR

AIDRNELFKFLDGKLLDINKDFQPYYGEGGRILEIRTPEAVTSIKKRGES

LGYTEGALLALAFIIILCCIPAILVVLVSYRQFKVRQAECTKTARIQAAL

PAAKPAVPAPAPVAAPPPPPPPPPGAHLYEELGDSSMHNLFLLYHFQQSR

GNNSVSEDRKHQQVVMPFSSNTIEAHKSAHVDGSLKSNKLKSARKFTFLS

DEDDLSAHNPLYKENISQVSTNSDISQRTDFVDPFSPKIQAKSKSLRGPR

EKIQRLWSQSVSLPRRLMRKVPNRPEIIDLQQWQGTRQKAENENTGICTN

KRGSSNPLLTTEEANLTEKEEIRQGETLMIEGTEQLKSLSSDSSFCFPRP

HFSFSTLPTVSRTVELKSEPNVISSPAECSLELSPSRPCVLHSSLSRRET

PICMLPIETERNIFENFAHPPNISPSACPLPPPPPISPPSPPPAPAPLAP

PPDISPFSLFCPPPSPPSIPLPLPPPTFFPLSVSTSGPPTPPLLPPFPTP

LPPPPPSIPCPPPPSASFLSTECVCITGVKCTTNLMPAEKIKSSMTQLST

TTVCKTDPQREPKGILRHVKNLAELEKSVANMYSQIEKNYLRTNVSELQT

MCPSEVTNMEITSEQNKGSLNNIVEGTEKQSHSQSTSL

An exemplary amino acid sequence of a mini-PCDH15 lacking EC4, EC5, EC6 and EC7 (V3) is set forth in SEQ ID NO: 83 (mini-PCDH15 V3: includes EC1-EC2-EC3-EC8-EC9-EC10-EC1-MAD12-TM-cyto CD2; different domains alternating in bold and regular font):

(SEQ ID NO: 83)
MFRQFYLWTCLASGIILGSLFEICLGQYDDDWQYEDCKLARGGPPATIVA

IDEESRNGTILVDNMLIKGTAGGPDPTIELSLKDNVDYWVLMDPVKQMLF

LNSTGRVLDRDPPMNIHSIVVQVQCINKKVGTIIYHEVRIVVRDRNDNSP

-continued

TFKHESYYATVNELTPVGTTIFTGFSGDNGATDIDDGPNGQIEYVIQYNP

DDPTSNDTFEIPLMLTGNIVLRKRLNYEDKTRYFVIIQANDRAQNLNERR

TTTTTLTVDVLDGDDLGPMFLPCVLVPNTRDCRPLTYQAAIPELRTPEEL

NPIIVTPPIQAIDQDRNIQPPSDRPGILYSILVGTPEDYPRFFHMHPRTA

ELSLLEPVNRDFHQKFDLVIKAEQDNGHPLPAFAGLHIEILDENNQSPVF

TNSTYTVLVEENLPAGTTILQIEAKDVDLGANVSYRIRSPEVKHFFALHP

FTGELSLLRSLDYEAFPDQEASITFLVEAFDIYGTMPPGIATVTVIVKDM

NDYPPVFSKRIYKGMVAPDAVKGTPITTVYAEDADPPGLPASRVRYRVDD

VQFPYPASIFEVEEDSGRVITRVNLNEEPTTIFKLVVVAFDDGEPVMSSS

ATVKILVLHPGEIPRFTQEEYRPPPVSELATKGTMVGVISAAAINQSIVY

SIVSGNEEDTFGINNITGVIYVNGPLDYETRTSYVLRVQADSLEVVLANL

RVPSKSNTAKVYIEIQDENNHPPVFQKKFYIGGVSEDARMFTSVLRVKAT

DKDTGNYSVMAYRLIIPPIKEGKEGFVVETYTGLIKTAMLFHNMRRSYFK

FQVIATDDYGKGLSGKADVLVSVVNQLDMQVIVSNVPPTLVEKKIEDLTE

ILDRYVQEQIPGAKVVVESIGARRHGDAFSLEDYTKCDLTVYAIDPQTNR

AIDRNELFKFLDGKLLDINKDFQPYYGEGGRILEIRTPEAVTSIKKRGES

LGYTEGALLALAFIIILCCIPAILVVLVSYRQFKVRQAECTKTARIQAAL

PAAKPAVPAPAPVAAPPPPPPPPPGAHLYEELGDSSMHKYEMPQYGSRRR

LLPPAGQEEYGEVVGEAEEEYEEEEEEPKKIKKPKVEIREPSEEEEVVVT

IEKPPAAEPTYTTWKRARIFPMIFKKVRGLADKRGIVDLEGEEWQRRLEE

EDKDYLKLTLDQEEATESTVESEEESSSDYTEYSEEESEFSESETTEEES

ESETPSEEEESSTPESEESESTESEGEKARKNIVLARRRPMVEEVKEVKG

RKEEPQEEQKEPKMEEEEHSEEEESGPAPVEESTDPEAQDIPEEGSAESA

SVEGGVESEEESESGSSSSSSESQSGGPWGYQVPAYDRSKNANQKKSPGA

NSEGYNTAL

An exemplary amino acid sequence of a mini-PCDH15 lacking EC4, EC5, EC6 and EC7 (V3) is set forth in SEQ ID NO: 84 (mini-PCDH15 V3: includes EC1-EC2-EC3-EC8-EC9-EC10-EC1-MAD12-TM-cyto CD3; different domains alternating in bold and regular font):

(SEQ ID NO: 84)

MFRQFYLWTCLASGIILGSLFEICLGQYDDDWQYEDCKLARGGPPATIVA

IDEESRNGTILVDNMLIKGTAGGPDPTIELSLKDNVDYWVLMDPVKQMLF

LNSTGRVLDRDPPMNIHSIVVQVQCINKKVGTIIYHEVRIVVRDRNDNSP

TFKHESYYATVNELTPVGTTIFTGFSGDNGATDIDDGPNGQIEYVIQYNP

DDPTSNDTFEIPLMLTGNIVLRKRLNYEDKTRYFVIIQANDRAQNLNERR

TTTTTLTVDVLDGDDLGPMFLPCVLVPNTRDCRPLTYQAAIPELRTPEEL

NPIIVTPPIQAIDQDRNIQPPSDRPGILYSILVGTPEDYPRFFHMHPRTA

ELSLLEPVNRDFHQKFDLVIKAEQDNGHPLPAFAGLHIEILDENNQSPVF

TNSTYTVLVEENLPAGTTILQIEAKDVDLGANVSYRIRSPEVKHFFALHP

FTGELSLLRSLDYEAFPDQEASITFLVEAFDIYGTMPPGIATVTVIVKDM

NDYPPVFSKRIYKGMVAPDAVKGTPITTVYAEDADPPGLPASRVRYR

VDDVQFPYPASIFEVEEDSGRVITRVNLNEEPTTIFKLVVVAFDDGEPVM

SSSATVKILVLHPGEIPRFTQEEYRPPPVSELATKGTMVGVISAAAINQS

IVYSIVSGNEEDTFGINNITGVIYVNGPLDYETRTSYVLRVQADSLEVVL

ANLRVPSKSNTAKVYIEIQDENNHPPVFQKKFYIGGVSEDARMFTSVLRV

KATDKDTGNYSVMAYRLIIPPIKEGKEGFVVETYTGLIKTAMLFHNMRRS

YFKFQVIATDDYGKGLSGKADVLVSVVNQLDMQVIVSNVPPTLVEKKIED

LTEILDRYVQEQIPGAKVVVESIGARRHGDAFSLEDYTKCDLTVYAIDPQ

TNRAIDRNELFKFLDGKLLDINKDFQPYYGEGGRILEIRTPEAVTSIKKR

GESLGYTEGALLALAFIIILCCIPAILVVLVSYRQFKVRQAECTKTARIQ

AALPAAKPAVPAPAPVAAPPPPPPPPPGAHLYEELGDSSMHKYEMPQYGS

RRRLLPPAGQEEYGEVVGEAEEEYEEEEWARKRMIKLVVDREYETSSTGE

DSAPECQRNRLHHPSIHSNINGNIYIAQNGSVVRTRRACLTDNLKVASPV

RLGGPFKKLDKLAVTHEENVPLNTLSKGPFSTEKMNARPTLVTFAPCPVG

TDNTAVKPLRNRLKSTVEQESMIDSKNIKEALEFHSDHTQSDDEELWMGP

WNNLHIPMTKL

An exemplary nucleic acid sequence encoding a mini-PCDH15 lacking EC4, EC5, EC6 and EC7 (V3) is set forth in SEQ ID NO: 36 (mini-PCDH15 V3: includes EC1-EC2-EC3-EC8-EC9-EC10-EC11-MAD12-TM-cyto CD1):

(SEQ ID NO: 36)

ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

-continued

```
TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAAGTCCTGTGTTCACCAATTCAACATACA

CTGTCCTTGTTGAAGAGAATTTGCCAGCTGGGACTACCATCCTTCAAATAGAGGCCAAAGATGT

CGACCTTGGAGCAAATGTGTCTTACCGGATAAGAAGCCCAGAAGTGAAGCACTTTTTTGCACTA

CATCCATTTACAGGAGAACTATCGCTTTTAAGGAGTTTAGATTATGAGGCATTTCCAGACCAAG

AAGCAAGTATCACTTTTCTGGTAGAGGCCTTTGATATTTATGGAACAATGCCACCTGGTATTGC

TACTGTCACAGTGATTGTAAAGGATATGAATGATTATCCTCCTGTCTTTAGTAAACGAATATAC

AAAGGGATGGTGGCTCCGGATGCAGTCAAGGGTACACCTATCACAACAGTTTATGCTGAAGATG

CAGACCCTCCTGGATTACCTGCAAGTCGTGTGAGGTATAGAGTAGATGATGTACAGTTTCCTTA

CCCTGCCAGTATTTTTGAAGTGGAAGAAGATTCTGGAAGAGTAATAACACGAGTCAATCTTAAT

GAAGAACCTACAACAATTTTTAAGTTGGTGGTGGTTGCTTTTGATGATGGGGAGCCTGTGATGT

CCAGCAGTGCCACAGTGAAGATTCTTGTCTTACATCCTGGTGAGATCCCACGCTTCACACAGGA

GGAATATAGACCTCCTCCAGTAAGTGAACTTGCCACCAAAGGGACCATGGTTGGTGTAATTTCT

GCTGCTGCCATTAATCAAAGTATTGTGTACTCCATTGTTTCAGGAAATGAAGAAGATACATTTG

GAATTAATAACATCACAGGTGTTATCTATGTGAATGGACCTCTGGATTATGAGACCAGGACAAG

CTATGTACTTCGAGTCCAAGCTGATTCCCTGGAAGTGGTCCTTGCCAATCTCCGAGTTCCTTCA

AAAAGCAATACAGCTAAAGTATACATTGAGATTCAGGATGAAAATAATCATCCCCCAGTGTTTC

AGAAAAAATTCTACATCGGAGGTGTATCTGAAGATGCAAGAATGTTTACTTCTGTACTCAGAGT

GAAGGCTACTGATAAAGATACTGGCAATTATAGTGTCATGGCCTACAGACTCATAATACCACCA

ATTAAAGAGGGAAAAGAAGGATTTGTAGTGGAAACATATACAGGGCTTATCAAAACTGCTATGC

TCTTCCATAATATGAGGAGATCCTACTTCAAGTTTCAAGTTATTGCAACTGACGACTATGGGAA

GGGACTGAGCGGCAAAGCCGATGTGTACTCGTCTCCGTGGTCAATCAGCTGGATATGCAAGTCATT

GTTTCCAATGTGCCTCCTACTCTAGTGGAAAAAAAGATAGAAGATCTTACAGAGATCTTGGATC

GCTATGTTCAGGAACAAATTCCTGGTGCCAAGGTCGTAGTGGAGTCCATTGGAGCTCGCCGGCA

TGGAGATGCCTTTTCCCTAGAAGATTACACCAAATGTGACTTGACTGTCTATGCAATTGACCCC

CAAACCAACAGAGCCATCGATAGAAATGAGCTTTTTAAATTTTTGGATGGCAAACTACTTGATA

TCAATAAAGACTTTCAGCCGTATTATGGGGAAGGAGGACGCATTCTGGAGATCCGGACTCCAGA

GGCAGTGACCAGCATTAAAAAGAGAGGAGAAAGTCTAGGATACACAGAAGGGGCCTTGTTGGCT

CTGGCCTTCATCATCATCCTCTGCTGCATTCCTGCCATCTTGGTGGTTTTGGTCAGCTACAGAC

AGTTTAAAGTACGTCAAGCTGAGTGTACAAAGACTGCACGAATTCAGGCCGCATTACCCGCGGC

TAAACCAGCAGTGCCGGCTCCTGCACCAGTGGCAGCGCCCCCGCCGCCGCCGCCGCCTCCGCCA

GGTGCGCATCTCTATGAAGAACTTGGAGACAGCTCAATGCATAATCTTTTCCTTCTCTACCATT

TTCAACAAAGCAGGGGAAATAACTCAGTCTCAGAAGACAGGAAACATCAACAAGTTGTGATGCC

CTTTTCTTCCAATACTATTGAGGCTCACAAGTCAGCTCATGTAGACGGATCACTTAAGAGCAAC
```

-continued

```
AAACTGAAGTCTGCAAGAAAATTCACATTTCTATCTGATGAGGATGACTTAAGTGCCCATAATC

CCCTTTATAAGGAAAACATAAGTCAAGTATCAACAAATTCAGACATTTCACAGAGAACAGATTT

TGTAGACCCATTTTCACCCAAAATACAAGCCAAGAGTAAGTCTCTGAGGGGCCCAAGAGAAAAG

ATTCAGAGGCTGTGGAGTCAGTCAGTCAGCTTACCCAGGAGGCTGATGAGGAAAGTTCCAAATA

GACCAGAGATCATAGATCTGCAGCAGTGGCAAGGCACCAGGCAGAAAGCTGAAAATGAAAACAC

TGGAATCTGTACAAACAAAAGAGGTAGCAGCAATCCATTGCTTACAACTGAAGAGGCAAATTTG

ACAGAGAAAGAGGAAATAAGGCAAGGTGAAACACTGATGATAGAAGGAACAGAACAGTTGAAAT

CTCTCTCTTCAGACTCTTCATTTTGCTTTCCCAGGCCTCACTTCTCATTCTCCACTTTGCCAAC

TGTTTCAAGAACTGTGGAACTCAAATCAGAACCTAATGTCATCAGTTCTCCTGCTGAGTGTTCC

TTGGAACTTTCTCCTTCAAGGCCTTGTGTTTTACATTCTTCACTCTCTAGGAGAGAGACACCTA

TTTGTATGTTACCTATTGAAACCGAAAGAAATATTTTTGAAAATTTTGCCCATCCACCAAACAT

CTCTCCTTCTGCCTGTCCCCTTCCCCCTCCTCCTCCTATTTCTCCTCCTTCTCCTCCTCCTGCT

CCTGCTCCTCTTGCTCCTCCTCCTGACATTTCTCCTTTTTCTCTTTTTTGTCCTCCTCCCTCTC

CTCCTTCTATCCCTCTTCCTCTTCCTCCTCCTACATTTTTTCCACTTTCCGTTTCAACGTCTGG

TCCCCCAACACCACCTCTTCTACCTCCATTTCCAACTCCTCTTCCTCCACCACCTCCTTCTATT

CCTTGCCCTCCACCTCCTTCAGCTTCATTTCTGTCCACAGAGTGTGTCTGTATAACAGGTGTTA

AATGCACGACCAACTTGATGCCTGCCGAGAAAATTAAGTCCTCTATGACACAGCTATCAACAAC

GACAGTGTGTAAAACAGACCCTCAGAGAGAACCAAAAGGCATCCTCAGACACGTTAAAAACTTA

GCAGAACTTGAAAAATCAGTAGCTAACATGTACAGTCAAATAGAAAAAAACTATCTACGCACAA

ATGTTTCAGAACTTCAAACTATGTGCCCTTCAGAAGTAACAAATATGGAAATCACATCTGAACA

AAACAAGGGGAGTTTGAACAATATTGTCGAGGGAACTGAAAAACAATCTCACAGTCAATCTACT

TCACTGTAA
```

An exemplary nucleic acid sequence encoding a mini-PCDH15 lacking EC4, EC5, EC6 and EC7 (V3) is set forth in SEQ ID NO: 85 (mini-PCDH15 V3: includes EC1-EC2-EC3-EC8-EC9-EC10-EC11-MAD12-TM-cyto CD2):

```
                                                    (SEQ ID NO: 85)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG
```

-continued

```
CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAAGTCCTGTGTTCACCAATTCAACATACA

CTGTCCTTGTTGAAGAGAATTTGCCAGCTGGGACTACCATCCTTCAAATAGAGGCCAAAGATGT

CGACCTTGGAGCAAATGTGTCTTACCGGATAAGAAGCCCAGAAGTGAAGCACTTTTTTGCACTA

CATCCATTTACAGGAGAACTATCGCTTTTAAGGAGTTTAGATTATGAGGCATTTCCAGACCAAG

AAGCAAGTATCACTTTTCTGGTAGAGGCCTTTGATATTTATGGAACAATGCCACCTGGTATTGC

TACTGTCACAGTGATTGTAAAGGATATGAATGATTATCCTCCTGTCTTTAGTAAACGAATATAC

AAAGGGATGGTGGCTCCGGATGCAGTCAAGGGTACACCTATCACAACAGTTTATGCTGAAGATG

CAGACCCTCCTGGATTACCTGCAAGTCGTGTGAGGTATAGAGTAGATGATGTACAGTTTCCTTA

CCCTGCCAGTATTTTTGAAGTGGAAGAAGATTCTGGAAGAGTAATAACACGAGTCAATCTTAAT

GAAGAACCTACAACAATTTTTAAGTTGGTGGTGGTTGCTTTTGATGATGGGGAGCCTGTGATGT

CCAGCAGTGCCACAGTGAAGATTCTTGTCTTACATCCTGGTGAGATCCCACGCTTCACACAGGA

GGAATATAGACCTCCTCCAGTAAGTGAACTTGCCACCAAAGGGACCATGGTTGGTGTAATTTCT

GCTGCTGCCATTAATCAAAGTATTGTGTACTCCATTGTTTCAGGAAATGAAGAAGATACATTTG

GAATTAATAACATCACAGGTGTTATCTATGTGAATGGACCTCTGGATTATGAGACCAGGACAAG

CTATGTACTTCGAGTCCAAGCTGATTCCCTGGAAGTGGTCCTTGCCAATCTCCGAGTTCCTTCA

AAAAGCAATACAGCTAAAGTATACATTGAGATTCAGGATGAAAATAATCATCCCCCAGTGTTTC

AGAAAAAATTCTACATCGGAGGTGTATCTGAAGATGCAAGAATGTTTACTTCTGTACTCAGAGT

GAAGGCTACTGATAAAGATACTGGCAATTATAGTGTCATGGCCTACAGACTCATAATACCACCA

ATTAAAGAGGGAAAAGAAGGATTTGTAGTGGAAACATATACAGGGCTTATCAAAACTGCTATGC

TCTTCCATAATATGAGGAGATCCTACTTCAAGTTTCAAGTTATTGCAACTGACGACTATGGGAA

GGGACTGAGCGGCAAAGCCGATGTACTCGTCTCCGTGGTCAATCAGCTGGATATGCAAGTCATT

GTTTCCAATGTGCCTCCTACTCTAGTGGAAAAAAAGATAGAAGATCTTACAGAGATCTTGGATC

GCTATGTTCAGGAACAAATTCCTGGTGCCAAGGTCGTAGTGGAGTCCATTGGAGCTCGCCGGCA

TGGAGATGCCTTTTCCCTAGAAGATTACACCAAATGTGACTTGACTGTCTATGCAATTGACCCC

CAAACCAACAGAGCCATCGATAGAAATGAGCTTTTTAAATTTTTGGATGGCAAACTACTTGATA

TCAATAAAGACTTTCAGCCGTATTATGGGGAAGGAGGACGCATTCTGGAGATCCGGACTCCAGA

GGCAGTGACCAGCATTAAAAAGAGAGGAGAAAGTCTAGGATACACAGAAGGGGCCTTGTTGGCT

CTGGCCTTCATCATCATCCTCTGCTGCATTCCTGCCATCTTGGTGGTTTTGGTCAGCTACAGAC

AGTTTAAAGTACGTCAAGCTGAGTGTACAAAGACTGCACGAATTCAGGCCGCATTACCCGCGGC

TAAACCAGCAGTGCCGGCTCCTGCACCAGTGGCAGCGCCCCCGCCGCCGCCGCCGCCTCCGCCA

GGTGCGCATCTCTATGAAGAACTTGGAGACAGCTCAATGCATAAGTATGAAATGCCTCAATATG

GGAGTCGCCGTCGATTGTTACCACCAGCTGGACAGGAGGAATATGGTGAGGTGGTTGGTGAAGC

TGAGGAAGAATATGAGGAGGAAGAGGAAGAGCCAAAGAAAATTAAAAAACCAAAGGTTGAAATT

AGAGAGCCTAGTGAGGAGGAAGAAGTAGTTGTAACTATCGAAAAACCACCAGCAGCTGAGCCTA

CATACACAACATGGAAGAGAGCCAGAATATTCCCCATGATTTTTAAGAAAGTTAGAGGATTAGC

TGATAAAAGAGGAATCGTTGACCTTGAGGGTGAAGAGTGGCAGAGACGCCTTGAGGAAGAAGAT

AAAGATTATTTGAAACTCACTCTGGACCAAGAGGAAGCAACAGAAAGCACTGTAGAATCAGAGG
```

-continued

```
AGGAATCCTCCAGCGACTATACTGAATACAGTGAAGAAGAGTCTGAGTTCAGTGAGTCTGAGAC

TACAGAAGAGGAATCTGAGTCAGAGACACCCTCTGAGGAGGAGGAGAGTTCCACCCCTGAATCA

GAAGAATCGGAATCCACAGAGTCAGAAGGAGAAAAAGCAAGGAAAAACATTGTGCTTGCAAGAA

GAAGGCCCATGGTTGAGGAGGTCAAGGAAGTCAAGGGTAGGAAAGAGGAGCCACAAGAAGAACA

AAAAGAACCTAAGATGGAAGAAGAAGAACACTCAGAAGAAGAAGAAAGTGGACCAGCCCCTGTG

GAAGAAAGTACAGACCCTGAAGCTCAAGATATCCCTGAAGAGGGCAGTGCAGAATCAGCTTCGG

TGGAAGGAGGTGTGGAAAGTGAGGAGGAATCAGAATCAGGTAGTAGTAGCAGTAGTAGCGAAAG

TCAGTCTGGAGGTCCATGGGGCTATCAGGTACCAGCGTATGACAGAAGCAAGAATGCAAACCAA

AAGAAGTCGCCAGGAGCAAACTCTGAAGGTTACAACACAGCACTTTGA
```

An exemplary nucleic acid sequence encoding a mini-PCDH15 lacking EC4, EC5, EC6 and EC7 (V3) is set forth in SEQ ID NO: 86 (mini-PCDH15 V3: includes EC1-EC2-EC3-EC8-EC9-EC10-EC11-MAD12-TM-cyto CD3):

(SEQ ID NO: 86)
```
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAAGTCCTGTGTTCACCAATTCAACATACA

CTGTCCTTGTTGAAGAGAATTTGCCAGCTGGGACTACCATCCTTCAAATAGAGGCCAAAGATGT

CGACCTTGGAGCAAATGTGTCTTACCGGATAAGAAGCCCAGAAGTGAAGCACTTTTTTGCACTA

CATCCATTTACAGGAGAACTATCGCTTTTAAGGAGTTTAGATTATGAGGCATTTCCAGACCAAG

AAGCAAGTATCACTTTTCTGGTAGAGGCCTTTGATATTTATGGAACAATGCCACCTGGTATTGC

TACTGTCACAGTGATTGTAAAGGATATGAATGATTATCCTCCTGTCTTTAGTAAACGAATATAC

AAAGGGATGGTGGCTCCGGATGCAGTCAAGGGTACACCTATCACAACAGTTTATGCTGAAGATG

CAGACCCTCCTGGATTACCTGCAAGTCGTGTGAGGTATAGAGTAGATGATGTACAGTTTCCTTA

CCCTGCCAGTATTTTTGAAGTGGAAGAAGATTCTGGAAGAGTAATAACACGAGTCAATCTTAAT

GAAGAACCTACAACAATTTTTAAGTTGGTGGTGGTTGCTTTTGATGATGGGGAGCCTGTGATGT
```

-continued
```
CCAGCAGTGCCACAGTGAAGATTCTTGTCTTACATCCTGGTGAGATCCCACGCTTCACACAGGA

GGAATATAGACCTCCTCCAGTAAGTGAACTTGCCACCAAAGGGACCATGGTTGGTGTAATTTCT

GCTGCTGCCATTAATCAAAGTATTGTGTACTCCATTGTTTCAGGAAATGAAGAAGATACATTTG

GAATTAATAACATCACAGGTGTTATCTATGTGAATGGACCTCTGGATTATGAGACCAGGACAAG

CTATGTACTTCGAGTCCAAGCTGATTCCCTGGAAGTGGTCCTTGCCAATCTCCGAGTTCCTTCA

AAAAGCAATACAGCTAAAGTATACATTGAGATTCAGGATGAAAATAATCATCCCCCAGTGTTTC

AGAAAAAATTCTACATCGGAGGTGTATCTGAAGATGCAAGAATGTTTACTTCTGTACTCAGAGT

GAAGGCTACTGATAAAGATACTGGCAATTATAGTGTCATGGCCTACAGACTCATAATACCACCA

ATTAAAGAGGGAAAAGAAGGATTTGTAGTGGAAACATATACAGGGCTTATCAAAACTGCTATGC

TCTTCCATAATATGAGGAGATCCTACTTCAAGTTTCAAGTTATTGCAACTGACGACTATGGGAA

GGGACTGAGCGGCAAAGCCGATGTACTCGTCTCCGTGGTCAATCAGCTGGATATGCAAGTCATT

GTTTCCAATGTGCCTCCTACTCTAGTGGAAAAAAAGATAGAAGATCTTACAGAGATCTTGGATC

GCTATGTTCAGGAACAAATTCCTGGTGCCAAGGTCGTAGTGGAGTCCATTGGAGCTCGCCGGCA

TGGAGATGCCTTTTCCCTAGAAGATTACACCAAATGTGACTTGACTGTCTATGCAATTGACCCC

CAAACCAACAGAGCCATCGATAGAAATGAGCTTTTTAAATTTTTGGATGGCAAACTACTTGATA

TCAATAAAGACTTTCAGCCGTATTATGGGGAAGGAGGACGCATTCTGGAGATCCGGACTCCAGA

GGCAGTGACCAGCATTAAAAAGAGAGGAGAAAGTCTAGGATACACAGAAGGGGCCTTGTTGGCT

CTGGCCTTCATCATCATCCTCTGCTGCATTCCTGCCATCTTGGTGGTTTTGGTCAGCTACAGAC

AGTTTAAAGTACGTCAAGCTGAGTGTACAAAGACTGCACGAATTCAGGCCGCATTACCCGCGGC

TAAACCAGCAGTGCCGGCTCCTGCACCAGTGGCAGCGCCCCCGCCGCCGCCGCCGCCTCCGCCA

GGTGCGCATCTCTATGAAGAACTTGGAGCAGCTCAATGCATAAGTATGAAATGCCTCAATATG

GGAGTCGCCGTCGATTGTTACCACCAGCTGGACAGGAGGAATATGGTGAGGTGGTTGGTGAAGC

TGAGGAAGAATATGAGGAGGAAGAGTGGGCAAGAAAAAGAATGATCAAGTTAGTTGTTGATCGA

GAGTATGAAACCAGCTCAACTGGAGAAGACAGTGCTCCTGAATGTCAGAGAAACCGTCTTCACC

ATCCTAGTATCCACAGTAATATCAACGGCAATATATATATTGCACAGAATGGTTCTGTGGTGAG

AACCCGCCGTGCCTGCCTCACGGACAACTTAAAAGTTGCTTCCCCTGTTCGACTGGGAGGGCCC

TTTAAGAAACTAGACAAGTTGGCAGTGACACATGAGGAGAATGTACCTCTGAACACATTATCAA

AGGGGCCATTTTCTACTGAAAAAATGAATGCAAGACCAACTCTGGTTACATTTGCCCCTTGCCC

TGTGGGGACTGACAATACAGCGGTGAAGCCACTAAGGAACAGGCTGAAAAGCACAGTTGAACAG

GAGTCCATGATTGACAGTAAGAACATCAAGGAGGCTTTGGAATTTCATAGTGACCACACACAGT

CTGATGATGAAGAGCTTTGGATGGGCCCCTGGAACAACCTCCATATACCAATGACAAAACTGTG

A
```

In some examples, the mini-PCDH15 lacks EC4, EC8, EC9 and EC10 domain. In some embodiments, the mini-PCDH15 includes EC1-EC2-EC3-EC5-EC6-EC7-EC11 of SEQ ID NO: 1, 53, 55, or 57. In one example, the mini-PCDH15 comprises an amino acid sequence at least 60%, 70%, 75%, 80%, 85%, 90%, 91%, 92%, 93%, 94%, 95%, 96%, 97%, 98%, 99% or 100% identical to SEQ ID NO: 37, 87, or 88. In some embodiments, the nucleic acid encoding the mini-PCDH15 lacking EC4, EC8, EC9 and EC10 is at least 60%, 70%, 75%, 80%, 85%, 90%, 91%, 92%, 93%, 94%, 95%, 96%, 97%, 98%, 99% or 100% identical to SEQ ID NO: 38, 89 or 90.

A exemplary amino acid sequence of a mini-PCDH15 lacking EC4, EC8, EC9 and EC10 (V5) is set forth in SEQ ID NO: 37 (mini-PCDH15 V5: includes EC1-EC2-EC3-EC5-EC6-EC7-EC11-MAD12-TM-cyto CD1; different domains alternating in bold and regular font):

```
                                    (SEQ ID NO: 37)
MFRQFYLWTCLASGIILGSLFEICLGQYDDDWQYEDCKLARGGPPATIVAI

DEESRNGTILVDNMLIKGTAGGPDPTIELSLKDNVDYWVLMDPVKQMLFLN

STGRVLDRDPPMNIHSIVVQVQCINKKVGTIIYHEVRIVVRDRNDNSPTFK

HESYYATVNELTPVGTTIFTGFSGDNGATDIDDGPNGQIEYVIQYNPDDPT

SNDTFEIPLMLTGNIVLRKRLNYEDKTRYFVIIQANDRAQNLNERRTTTTT
```

-continued

LTVDVLDGDDLGPMFLPCVLVPNTRDCRPLTYQAAIPELRTPEELNPIIVT

PPIQAIDQDRNIQPPSDRPGILYSILVGTPEDYPRFFHMHPRTAELSLLEP

VNRDFHQKFDLVIKAEQDNGHPLPAFAGLHIEILDENNQTPTFPEISYDVY

VYTDMRPGDSVIQLTAVDADEGSNGEITYEILVGAQGDFIINKTTGLITIA

PGVEMIVGRTYALTVQAADNAPPAERRNSICTVYIEVLPPNNQSPPRFPQL

MYSLEISEAMRVGAVLLNLQATDREGDSITYAIENGDPQRVFNLSETTGIL

TLGKALDRESTDRYILIITASDGRPDGTSTATVNIVVTDVNDNAPVFDPYL

PRNLSVVEEEANAFVGQVKATDPDAGINGQVHYSLGNFNNLFRITSNGSIY

TAVKLNREVRDYYELVVVATDGAVHPRHSTLTLAIKVLD<u>IDDDN</u>PPVFQKKF

YIGGVSEDARMFTSVLRVKATDKDTGNYSVMAYRLIIPPIKEGKEGFVVET

YTGLIKTAMLFHNMRRSYFKFQVIATDDYGKGLSGKADVLVSVVNQLDMQV

IVSNVPPTLVEKKIEDLTEILDRYVQEQIPGAKVVVESIGARRHGDAFSLE

DYTKCDLTVYAIDPQTNRAIDRNELFKFLDGKLLDINKDFQPYYGEGGRIL

EIRTPEAVTSIKKRGESLGYTEGALLALAFIIILCCIPAILVVLVSYRQFK

VRQAECTKTARIQAALPAAKPAVPAPAPVAAPPPPPPPPPGAHLYEELGDS

SMHNLFLLYHFQQSRGNNSVSEDRKHQQVVMPFSSNTIEAHKSAHVDGSLK

SNKLKSARKFTFLSDEDDLSAHNPLYKENISQVSTNSDISQRTDFVDPFSP

KIQAKSKSLRGPREKIQRLWSQSVSLPRRLMRKVPNRPEIIDLQQWQGTRQ

KAENENTGICTNKRGSSNPLLTTEEANLTEKEEIRQGETLMIEGTEQLKSL

SSDSSFCFPRPHFSFSTLPTVSRTVELKSEPNVISSPAECSLELSPSRPCV

LHSSLSRRETPICMLPIETERNIFENFAHPPNISPSACPLPPPPPISPPSP

PPAPAPLAPPPDISPFSLFCPPPSPPSIPLPLPPPTFFPLSVSTSGPPTPP

LLPPFPTPLPPPPPSIPCPPPPSASFLSTECVCITGVKCTTNLMPAEKIKS

SMTQLSTTTVCKTDPQREPKGILRHVKNLAELEKSVANMYSQIEKNYLRTN

VSELQTMCPSEVTNMEITSEQNKGSLNNIVEGTEKQSHSQSTSL

An exemplary amino acid sequence of a mini-PCDH15 lacking EC4, EC8, EC9 and EC10 (V5) is set forth in SEQ ID NO: 87 (mini-PCDH15 V5: includes EC1-EC2-EC3-EC5-EC6-EC7-EC11-MAD12-TM-cyto CD2; different domains alternating in bold and regular font):

(SEQ ID NO: 87)
MFRQFYLWTCLASGIILGSLFEICLGQYDDDWQYEDCKLARGGPPATIVAI

DEESRNGTILVDNMLIKGTAGGPDPTIELSLKDNVDYWVLMDPVKQMLFLN

STGRVLDRDPPMNIHSIVVQVQCINKKVGTIIYHEVRIVVRDRNDNSPTFK

HESYYATVNELTPVGTTIFTGFSGDNGATDIDDGPNGQIEYVIQYNPDDPT

SNDTFEIPLMLTGNIVLRKRLNYEDKTRYFVIIQANDRAQNLNERRTTTTT

LTVDVLDGDDLGPMFLPCVLVPNTRDCRPLTYQAAIPELRTPEELNPIIVT

PPIQAIDQDRNIQPPSDRPGILYSILVGTPEDYPRFFHMHPRTAELSLLEP

VNRDFHQKFDLVIKAEQDNGHPLPAFAGLHIEILDENNQTPTFPEISYDVY

VYTDMRPGDSVIQLTAVDADEGSNGEITYEILVGAQGDFIINKTTGLITIA

PGVEMIVGRTYALTVQAADNAPPAERRNSICTVYIEVLPPNNQSPPRFPQL

-continued

MYSLEISEAMRVGAVLLNLQATDREGDSITYAIENGDPQRVFNLSETTGIL

TLGKALDRESTDRYILIITASDGRPDGTSTATVNIVVTDVNDNAPVFDPYL

PRNLSVVEEEANAFVGQVKATDPDAGINGQVHYSLGNFNNLFRITSNGSIY

TAVKLNREVRDYYELVVVATDGAVHPRHSTLTLAIKVLD<u>IDDDN</u>PPVFQKKF

YIGGVSEDARMFTSVLRVKATDKDTGNYSVMAYRLIIPPIKEGKEGFVVET

YTGLIKTAMLFHNMRRSYFKFQVIATDDYGKGLSGKADVLVSVVNQLDMQV

IVSNVPPTLVEKKIEDLTEILDRYVQEQIPGAKVVVESIGARRHGDAFSLE

DYTKCDLTVYAIDPQTNRAIDRNELFKFLDGKLLDINKDFQPYYGEGGRIL

EIRTPEAVTSIKKRGESLGYTEGALLALAFIIILCCIPAILVVLVSYRQFK

VRQAECTKTARIQAALPAAKPAVPAPAPVAAPPPPPPPPPGAHLYEELGDS

SMHKYEMPQYGSRRRLLPPAGQEEYGEVVGEAEEEYEEEEEEPKKIKKPKV

EIREPSEEEEVVVTIEKPPAAEPTYTTWKRARIETMIFKKVRGLADKRGIV

DLEGEEWQRRLEEEDKDYLKLTLDQEEATESTVESEEESSSDYTEYSEEES

EFSESETTEEESESETPSEEEESSTPESEESESTESEGEKARKNIVLARRR

PMVEEVKEVKGRKEEPQEEQKEPKMEEEEHSEEEESGPAPVEESTDPEAQD

IPEEGSAESASVEGGVESEEEESESGSSSSSSESQSGGPWGYQVPAYDRSKN

ANQKKSPGANSEGYNTAL

An exemplary amino acid sequence of a mini-PCDH15 lacking EC4, EC8, EC9 and EC10 (V5) is set forth in SEQ ID NO: 88 (mini-PCDH15 V5: includes EC1-EC2-EC3-EC5-EC6-EC7-EC11-MAD12-TM-cyto CD3; different domains alternating in bold and regular font):

(SEQ ID NO: 88)
MFRQFYLWTCLASGIILGSLFEICLGQYDDDWQYEDCKLARGGPPATIVAI

DEESRNGTILVDNMLIKGTAGGPDPTIELSLKDNVDYWVLMDPVKQMLFLN

STGRVLDRDPPMNIHSIVVQVQCINKKVGTIIYHEVRIVVRDRNDNSPTFK

HESYYATVNELTPVGTTIFTGFSGDNGATDIDDGPNGQIEYVIQYNPDDPT

SNDTFEIPLMLTGNIVLRKRLNYEDKTRYFVIIQANDRAQNLNERRTTTTT

LTVDVLDGDDLGPMFLPCVLVPNTRDCRPLTYQAAIPELRTPEELNPIIVT

PPIQAIDQDRNIQPPSDRPGILYSILVGTPEDYPRFFHMHPRTAELSLLEP

VNRDFHQKFDLVIKAEQDNGHPLPAFAGLHIEILDENNQTPTFPEISYDVY

VYTDMRPGDSVIQLTAVDADEGSNGEITYEILVGAQGDFIINKTTGLITIA

PGVEMIVGRTYALTVQAADNAPPAERRNSICTVYIEVLPPNNQSPPRFPQL

MYSLEISEAMRVGAVLLNLQATDREGDSITYAIENGDPQRVFNLSETTGIL

TLGKALDRESTDRYILIITASDGRPDGTSTATVNIVVTDVNDNAPVFDPYL

PRNLSVVEEEANAFVGQVKATDPDAGINGQVHYSLGNFNNLFRITSNGSIY

TAVKLNREVRDYYELVVVATDGAVHPRHSTLTLAIKVLD<u>IDDDN</u>PPVFQKKF

YIGGVSEDARMFTSVLRVKATDKDTGNYSVMAYRLIIPPIKEGKEGFVVET

YTGLIKTAMLFHNMRRSYFKFQVIATDDYGKGLSGKADVLVSVVNQLDMQV

IVSNVPPTLVEKKIEDLTEILDRYVQEQIPGAKVVVESIGARRHGDAFSLE

DYTKCDLTVYAIDPQTNRAIDRNELFKFLDGKLLDINKDFQPYYGEGGRIL

EIRTPEAVTSIKKRGESLGYTEGALLALAFIIILCCIPAILVVLVSYRQFK

-continued

VRQAECTKTARIQAALPAAKPAVPAPAPVAAPPPPPPPPPGAHLYEELGDS

SMHKYEMPQYGSRRRLLPPAGQEEYGEVVGEAEEEYEEEEWARKRMIKLVV

DREYETSSTGEDSAPECQRNRLHHPSIHSNINGNIYIAQNGSVVRTRRACL

TDNLKVASPVRLGGPFKKLDKLAVTHEENVPLNTLSKGPFSTEKMNARPTL

-continued

VTFAPCPVGTDNTAVKPLRNRLKSTVEQESMIDSKNIKEALEFHSDHTQSD

DEELWMGPWNNLHIPMTKL

An exemplary nucleic acid sequence encoding a mini-PCDH15 lacking EC4, EC8, EC9 and EC10 (V5) is set forth in SEQ ID NO: 38 (mini-PCDH15 V5: includes EC1-EC2-EC3-EC5-EC6-EC7-EC11-MAD12-TM-cyto CD1):

(SEQ ID NO: 38)

ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAACGCCAACCTTCCCTGAAATATCCTATG

ATGTGTATGTTTATACAGACATGAGACCTGGGGACAGTGTCATACAGCTCACTGCAGTCGACGC

AGACGAAGGGTCAAATGGGGAGATCACATATGAAATCCTTGTTGGGGGCTCAGGGAGACTTCATC

ATCAATAAAACAACAGGGCTTATCACCATCGCTCCAGGGGTGGAAATGATAGTCGGGCGGACTT

ACGCACTCACGGTCCAAGCAGCGGATAATGCTCCTCCTGCAGAGCGAAGGAACTCCATCTGCAC

TGTGTATATTGAAGTGCTTCCACCCAAATAATCAAAGCCCTCCTCGCTTCCCACAGCTGATGTAT

AGCCTTGAAATTAGTGAAGCCATGAGGGTTGGTGCTGTTTTATTAAATCTACAGGCAACTGATC

GAGAGGGAGACTCAATAACATATGCCATTGAGAATGGAGATCCTCAGAGAGTTTTTAATCTTTC

AGAAACCACGGGGATTCTAACCTTAGGGAAAGCACTGGACAGGGAAAGCACTGATCGCTACATT

CTGATCATCACAGCTTCAGATGGCAGGCCAGATGGGACCTCAACTGCCACAGTAAACATAGTGG

TGACAGATGTCAATGACAATGCTCCAGTGTTTGATCCTTATCTGCCAAGAAATTTATCTGTGGT

GGAAGAAGAAGCCAATGCCTTTGTGGGTCAAGTAAAAGCAACAGACCCTGATGCTGGAATAAAT

GGTCAAGTGCACTACAGTTTGGGTAACTTTAATAATCTTTTTCGTATCACATCCAATGGGAGCA

TTTACACAGCAGTGAAGCTTAACAGAGAAGTCAGGGACTACTATGAACTTGTTGTTGTGGCAAC

AGATGGAGCAGTACACCCTCGTCATTCAACTCTAACCTTGGCCATCAAGGTTTTGGACATTGAT

GATAACCCCCCAGTGTTTCAGAAAAAAATTCTACATCGGAGGTGTATCTGAAGATGCAAGAATGT

-continued

TTACTTCTGTACTCAGAGTGAAGGCTACTGATAAAGATACTGGCAATTATAGTGTCATGGCCTA

CAGACTCATAATACCACCAATTAAAGAGGGAAAAGAAGGATTTGTAGTGGAAACATATACAGGG

CTTATCAAAACTGCTATGCTCTTCCATAATATGAGGAGATCCTACTTCAAGTTTCAAGTTATTG

CAACTGACGACTATGGGAAGGGACTGAGCGGCAAAGCCGATGTACTCGTCTCCGTGGTCAATCA

GCTGGATATGCAAGTCATTGTTTCCAATGTGCCTCCTACTCTAGTGGAAAAAAAGATAGAAGAT

CTTACAGAGATCTTGGATCGCTATGTTCAGGAACAAATTCCTGGTGCCAAGGTCGTAGTGGAGT

CCATTGGAGCTCGCCGGCATGGAGATGCCTTTTCCCTAGAAGATTACACCAAATGTGACTTGAC

TGTCTATGCAATTGACCCCCAAACCAACAGAGCCATCGATAGAAATGAGCTTTTTAAATTTTTG

GATGGCAAACTACTTGATATCAATAAAGACTTTCAGCCGTATTATGGGGAAGGAGGACGCATTC

TGGAGATCCGGACTCCAGAGGCAGTGACCAGCATTAAAAAGAGAGGAGAAAGTCTAGGATACAC

AGAAGGGGCCTTGTTGGCTCTGGCCTTCATCATCATCCTCTGCTGCATTCCTGCCATCTTGGTG

GTTTTGGTCAGCTACAGACAGTTTAAAGTACGTCAAGCTGAGTGTACAAAGACTGCACGAATTC

AGGCCGCATTACCCGCGGCTAAACCAGCAGTGCCGGCTCCTGCACCAGTGGCAGCGCCCCCGCC

GCCGCCGCCGCCTCCGCCAGGTGCGCATCTCTATGAAGAACTTGGAGACAGCTCAATGCATAAT

CTTTTCCTTCTCTACCATTTTCAACAAAGCAGGGGAAATAACTCAGTCTCAGAAGACAGGAAAC

ATCAACAAGTTGTGATGCCCTTTTCTTCCAATACTATTGAGGCTCACAAGTCAGCTCATGTAGA

CGGATCACTTAAGAGCAACAAACTGAAGTCTGCAAGAAAATTCACATTTCTATCTGATGAGGAT

GACTTAAGTGCCCATAATCCCCTTTATAAGGAAAACATAAGTCAAGTATCAACAAATTCAGACA

TTTCACAGAGAACAGATTTTGTAGACCCATTTTCACCCAAAATACAAGCCAAGAGTAAGTCTCT

GAGGGGCCCAAGAGAAAAGATTCAGAGGCTGTGGAGTCAGTCAGTCAGCTTACCCAGGAGGCTG

ATGAGGAAAGTTCCAAATAGACCAGAGATCATAGATCTGCAGCAGTGGCAAGGCACCAGGCAGA

AAGCTGAAAATGAAAACACTGGAATCTGTACAAACAAAAGAGGTAGCAGCAATCCATTGCTTAC

AACTGAAGAGGCAAATTTGACAGAGAAAGAGGAAATAAGGCAAGGTGAAACACTGATGATAGAA

GGAACAGAACAGTTGAAATCTCTCTCTTCAGACTCTTCATTTTGCTTTCCCAGGCCTCACTTCT

CATTCTCCACTTTGCCAACTGTTTCAAGAACTGTGGAACTCAAATCAGAACCTAATGTCATCAG

TTCTCCTGCTGAGTGTTCCTTGGAACTTTCTCCTTCAAGGCCTTGTGTTTTACATTCTTCACTC

TCTAGGAGAGAGACACCTATTTGTATGTTACCTATTGAAACCGAAAGAAATATTTTTGAAAATT

TTGCCCATCCACCAAACATCTCTCCTTCTGCCTGTCCCCTTCCCCCTCCTCCTCCTATTTCTCC

TCCTTCTCCTCCTCCTGCTCCTGCTCCTCTTGCTCCTCCTCCTGACATTTCTCCTTTTTCTCTT

TTTTGTCCTCCTCCCTCTCCTCCTTCTATCCCTCTTCCTCTTCCTCCTCCTACATTTTTTCCAC

TTTCCGTTTCAACGTCTGGTCCCCCAACACCACCTCTTCTACCTCCATTTCCAACTCCTCTTCC

TCCACCACCTCCTTCTATTCCTTGCCCTCCACCTCCTTCAGCTTCATTTCTGTCCACAGAGTGT

GTCTGTATAACAGGTGTTAAATGCACGACCAACTTGATGCCTGCCGAGAAAATTAAGTCCTCTA

TGACACAGCTATCAACAACGACAGTGTGTAAAACAGACCCTCAGAGAGAACCAAAAGGCATCCT

CAGACACGTTAAAAACTTAGCAGAACTTGAAAAATCAGTAGCTAACATGTACAGTCAAATAGAA

AAAAACTATCTACGCACAAATGTTTCAGAACTTCAAACTATGTGCCCTTCAGAAGTAACAAATA

TGGAAATCACATCTGAACAAAACAAGGGGAGTTTGAACAATATTGTCGAGGGAACTGAAAAACA

ATCTCACAGTCAATCTACTTCACTGTAA

An exemplary nucleic acid sequence encoding a mini-PCDH15 lacking EC4, EC8, EC9 and EC10 (V5) is set forth in SEQ ID NO: 89 (mini-PCDH15 V5: includes EC1-EC2-EC3-EC5-EC6-EC7-EC11-MAD12-TM-cyto CD2):

```
(SEQ ID NO: 89)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAACGCCAACCTTCCCTGAAATATCCTATG

ATGTGTATGTTTATACAGACATGAGACCTGGGGACAGTGTCATACAGCTCACTGCAGTCGACGC

AGACGAAGGGTCAAATGGGGAGATCACATATGAAATCCTTGTTGGGGGCTCAGGGAGACTTCATC

ATCAATAAAACAACAGGGCTTATCACCATCGCTCCAGGGGTGGAAATGATAGTCGGGCGGACTT

ACGCACTCACGGTCCAAGCAGCGGATAATGCTCCTCCTGCAGAGCGAAGGAACTCCATCTGCAC

TGTGTATATTGAAGTGCTTCCACCAAATAATCAAAGCCCTCCTCGCTTCCCACAGCTGATGTAT

AGCCTTGAAATTAGTGAAGCCATGAGGGTTGGTGCTGTTTTATTAAATCTACAGGCAACTGATC

GAGAGGGAGACTCAATAACATATGCCATTGAGAATGGAGATCCTCAGAGAGTTTTTAATCTTTC

AGAAACCACGGGGATTCTAACCTTAGGGAAAGCACTGGACAGGGAAAGCACTGATCGCTACATT

CTGATCATCACAGCTTCAGATGGCAGGCCAGATGGGACCTCAACTGCCACAGTAAACATAGTGG

TGACAGATGTCAATGACAATGCTCCAGTGTTTGATCCTTATCTGCCAAGAAATTTATCTGTGGT

GGAAGAAGAAGCCAATGCCTTTGTGGGTCAAGTAAAAGCAACAGACCCTGATGCTGGAATAAAT

GGTCAAGTGCACTACAGTTTGGGTAACTTTAATAATCTTTTTCGTATCACATCCAATGGGAGCA

TTTACACAGCAGTGAAGCTTAACAGAGAAGTCAGGGACTACTATGAACTTGTTGTTGTGGCAAC

AGATGGAGCAGTACACCCTCGTCATTCAACTCTAACCTTGGCCATCAAGGTTTTGGACATTGAT

GATAACCCCCCAGTGTTTCAGAAAAAATTCTACATCGGAGGTGTATCTGAAGATGCAAGAATGT

TTACTTCTGTACTCAGAGTGAAGGCTACTGATAAAGATACTGGCAATTATAGTGTCATGGCCTA

CAGACTCATAATACCACCAATTAAAGAGGGAAAAGAAGGATTTGTAGTGGAAACATATACAGGG

CTTATCAAAACTGCTATGCTCTTCCATAATATGAGGAGATCCTACTTCAAGTTTCAAGTTATTG

CAACTGACGACTATGGGAAAGGGACTGAGCGGCAAAGCCGATGTACTCGTCTCCGTGGTCAATCA

GCTGGATATGCAAGTCATTGTTTCCAATGTGCCTCCTACTCTAGTGGAAAAAAAGATAGAAGAT
```

-continued

CTTACAGAGATCTTGGATCGCTATGTTCAGGAACAAATTCCTGGTGCCAAGGTCGTAGTGGAGT

CCATTGGAGCTCGCCGGCATGGAGATGCCTTTTCCCTAGAAGATTACACCAAATGTGACTTGAC

TGTCTATGCAATTGACCCCCAAACCAACAGAGCCATCGATAGAAATGAGCTTTTTAAATTTTTG

GATGGCAAACTACTTGATATCAATAAAGACTTTCAGCCGTATTATGGGGAAGGAGGACGCATTC

TGGAGATCCGGACTCCAGAGGCAGTGACCAGCATTAAAAAGAGAGGAGAAAGTCTAGGATACAC

AGAAGGGGCCTTGTTGGCTCTGGCCTTCATCATCATCCTCTGCTGCATTCCTGCCATCTTGGTG

GTTTTGGTCAGCTACAGACAGTTTAAAGTACGTCAAGCTGAGTGTACAAAGACTGCACGAATTC

AGGCCGCATTACCCGCGGCTAAACCAGCAGTGCCGGCTCCTGCACCAGTGGCAGCGCCCCCGCC

GCCGCCGCCGCCTCCGCCAGGTGCGCATCTCTATGAAGAACTTGGAGACAGCTCAATGCATAAG

TATGAAATGCCTCAATATGGGAGTCGCCGTCGATTGTTACCACCAGCTGGACAGGAGGAATATG

GTGAGGTGGTTGGTGAAGCTGAGGAAGAATATGAGGAGGAAGAGGAAGAGCCAAAGAAAATTAA

AAAACCAAAGGTTGAAATTAGAGAGCCTAGTGAGGAGGAAGAAGTAGTTGTAACTATCGAAAAA

CCACCAGCAGCTGAGCCTACATACACAACATGGAAGAGAGCCAGAATATTCCCCATGATTTTTA

AGAAAGTTAGAGGATTAGCTGATAAAAGAGGAATCGTTGACCTTGAGGGTGAAGAGTGGCAGAG

ACGCCTTGAGGAAGAAGATAAAGATTATTTGAAACTCACTCTGGACCAAGAGGAAGCAACAGAA

AGCACTGTAGAATCAGAGGAGGAATCCTCCAGCGACTATACTGAATACAGTGAAGAAGAGTCTG

AGTTCAGTGAGTCTGAGACTACAGAAGAGGAATCTGAGTCAGAGACACCCTCTGAGGAGGAGGA

GAGTTCCACCCCTGAATCAGAAGAATCGGAATCCACAGAGTCAGAAGGAGAAAAAGCAAGGAAA

AACATTGTGCTTGCAAGAAGAAGGCCCATGGTTGAGGAGGTCAAGGAAGTCAAGGGTAGGAAAG

AGGAGCCACAAGAAGAACAAAAAGAACCTAAGATGGAAGAAGAAGAACACTCAGAAGAAGAAGA

AAGTGGACCAGCCCCTGTGGAAGAAAGTACAGACCCTGAAGCTCAAGATATCCCTGAAGAGGGC

AGTGCAGAATCAGCTTCGGTGGAAGGAGGTGTGGAAAGTGAGGAGGAATCAGAATCAGGTAGTA

GTAGCAGTAGTAGCGAAAGTCAGTCTGGAGGTCCATGGGGCTATCAGGTACCAGCGTATGACAG

AAGCAAGAATGCAAACCAAAAGAAGTCGCCAGGAGCAAACTCTGAAGGTTACAACACAGCACTT

TGA

An exemplary nucleic acid sequence encoding a mini-PCDH15 lacking EC4, EC8, EC9 and EC10 (V5) is set forth in SEQ ID NO: 90 (mini-PCDH15 V5: includes EC1-EC2-EC3-EC5-EC6-EC7-EC11-MAD12-TM-cyto CD3):

(SEQ ID NO: 90)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

-continued

```
ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAACGCCAACCTTCCCTGAAATATCCTATG

ATGTGTATGTTTATACAGACATGAGACCTGGGGACAGTGTCATACAGCTCACTGCAGTCGACGC

AGACGAAGGGTCAAATGGGGAGATCACATATGAAATCCTTGTTGGGGCTCAGGGAGACTTCATC

ATCAATAAAACAACAGGGCTTATCACCATCGCTCCAGGGGTGGAAATGATAGTCGGGCGGACTT

ACGCACTCACGGTCCAAGCAGCGGATAATGCTCCTCCTGCAGAGCGAAGGAACTCCATCTGCAC

TGTGTATATTGAAGTGCTTCCACCAAATAATCAAAGCCCTCCTCGCTTCCCACAGCTGATGTAT

AGCCTTGAAATTAGTGAAGCCATGAGGGTTGGTGCTGTTTTATTAAATCTACAGGCAACTGATC

GAGAGGGAGACTCAATAACATATGCCATTGAGAATGGAGATCCTCAGAGAGTTTTTAATCTTTC

AGAAACCACGGGGATTCTAACCTTAGGGAAAGCACTGGACAGGGAAAGCACTGATCGCTACATT

CTGATCATCACAGCTTCAGATGGCAGGCCAGATGGGACCTCAACTGCCACAGTAAACATAGTGG

TGACAGATGTCAATGACAATGCTCCAGTGTTTGATCCTTATCTGCCAAGAAATTTATCTGTGGT

GGAAGAAGAAGCCAATGCCTTTGTGGGTCAAGTAAAAGCAACAGACCCTGATGCTGGAATAAAT

GGTCAAGTGCACTACAGTTTGGGTAACTTTAATAATCTTTTTCGTATCACATCCAATGGGAGCA

TTTACACAGCAGTGAAGCTTAACAGAGAAGTCAGGGACTACTATGAACTTGTTGTTGTGGCAAC

AGATGGAGCAGTACACCCTCGTCATTCAACTCTAACCTTGGCCATCAAGGTTTTGGACATTGAT

GATAACCCCCCAGTGTTTCAGAAAAAATTCTACATCGGAGGTGTATCTGAAGATGCAAGAATGT

TTACTTCTGTACTCAGAGTGAAGGCTACTGATAAAGATACTGGCAATTATAGTGTCATGGCCTA

CAGACTCATAATACCACCAATTAAAGAGGGAAAAGAAGGATTTGTAGTGGAAACATATACAGGG

CTTATCAAAACTGCTATGCTCTTCCATAATATGAGGAGATCCTACTTCAAGTTTCAAGTTATTG

CAACTGACGACTATGGGAAGGGACTGAGCGGCAAAGCCGATGTACTCGTCTCCGTGGTCAATCA

GCTGGATATGCAAGTCATTGTTTCCAATGTGCCTCCTACTCTAGTGGAAAAAAAGATAGAAGAT

CTTACAGAGATCTTGGATCGCTATGTTCAGGAACAAATTCCTGGTGCCAAGGTCGTAGTGGAGT

CCATTGGAGCTCGCCGGCATGGAGATGCCTTTTCCCTAGAAGATTACACCAAATGTGACTTGAC

TGTCTATGCAATTGACCCCCAAACCAACAGAGCCATCGATAGAAATGAGCTTTTTAAATTTTTG

GATGGCAAACTACTTGATATCAATAAAGACTTTCAGCCGTATTATGGGGAAGGAGGACGCATTC

TGGAGATCCGGACTCCAGAGGCAGTGACCAGCATTAAAAAGAGAGGAGAAAGTCTAGGATACAC

AGAAGGGGCCTTGTTGGCTCTGGCCTTCATCATCATCCTCTGCTGCATTCCTGCCATCTTGGTG

GTTTTGGTCAGCTACAGACAGTTTAAAGTACGTCAAGCTGAGTGTACAAAGACTGCACGAATTC

AGGCCGCATTACCCGCGGCTAAACCAGCAGTGCCGGCTCCTGCACCAGTGGCAGCGCCCCCGCC

GCCGCCGCCGCCTCCGCCAGGTGCGCATCTCTATGAAGAACTTGGAGACAGCTCAATGCATAAG

TATGAAATGCCTCAATATGGGAGTCGCCGTCGATTGTTACCACCAGCTGGACAGGAGGAATATG

GTGAGGTGGTTGGTGAAGCTGAGGAAGAATATGAGGAGGAAGAGTGGGCAAGAAAAAGAATGAT

CAAGTTAGTTGTTGATCGAGAGTATGAAACCAGCTCAACTGGAGAAGACAGTGCTCCTGAATGT

CAGAGAAACCGTCTTCACCATCCTAGTATCCACAGTAATATCAACGGCAATATATATATTGCAC
```

-continued

```
AGAATGGTTCTGTGGTGAGAACCCGCCGTGCCTGCCTCACGGACAACTTAAAAGTTGCTTCCCC

TGTTCGACTGGGAGGGCCCTTTAAGAAACTAGACAAGTTGGCAGTGACACATGAGGAGAATGTA

CCTCTGAACACATTATCAAAGGGGCCATTTTCTACTGAAAAAATGAATGCAAGACCAACTCTGG

TTACATTTGCCCCTTGCCCTGTGGGGACTGACAATACAGCGGTGAAGCCACTAAGGAACAGGCT

GAAAAGCACAGTTGAACAGGAGTCCATGATTGACAGTAAGAACATCAAGGAGGCTTTGGAATTT

CATAGTGACCACACACAGTCTGATGATGAAGAGCTTTGGATGGGCCCCTGGAACAACCTCCATA

TACCAATGACAAAACTGTGA
```

In some examples, the mini-PCDH15 lacks EC5, EC6, EC9 and EC10 domain. In some embodiments, the mini-PCDH15 includes EC1-EC2-EC3-EC4-EC7-EC8-EC11 of SEQ ID NO: 1, 53, 55, or 57. In one example, the mini-PCDH15 comprises an amino acid sequence at least 60%, 70%, 75%, 80%, 85%, 90%, 91%, 92%, 93%, 94%, 95%, 96%, 97%, 98%, 99% or 100% identical to SEQ ID NO: 39, 91, or 92. In some embodiments, the nucleic acid encoding the mini-PCDH15 lacking EC5, EC6, EC9 and EC10 is at least 60%, 70%, 75%, 80%, 85%, 90%, 91%, 92%, 93%, 94%, 95%, 96%, 97%, 98%, 99% or 100% identical to SEQ ID NO: 40, 93, or 94.

An exemplary amino acid sequence of a mini-PCDH15 lacking EC5, EC6, EC9 and EC10 (V6) is set forth in SEQ ID NO: 39 (mini-PCDH15 V6: includes EC1-EC2-EC3-EC4-EC7-EC8-EC11-MAD12-TM-cyto CD1; different domains alternating in bold and regular font):

(SEQ ID NO: 39)
```
MFRQFYLWTCLASGIILGSLFEICLGQYDDDWQYEDCKLARGGPPATIVAI

DEESRNGTILVDNMLIKGTAGGPDPTIELSLKDNVDYWVLMDPVKQMLFLN

STGRVLDRDPPMNIHSIVVQVQCINKKVGTIIYHEVRIVVRDRNDNSPTFK

HESYYATVNELTPVGTTIFTGFSGDNGATDIDDGPNGQIEYVIQYNPDDPT

SNDTFEIPLMLTGNIVLRKRLNYEDKTRYFVIIQANDRAQNLNERRTTTTT

LTVDVLDGDDLGPMFLPCVLVPNTRDCRPLTYQAAIPELRTPEELNPIIVT

PPIQAIDQDRNIQPPSDRPGILYSILVGTPEDYPRFFHMHPRTAELSLLEP

VNRDFHQKFDLVIKAEQDNGHPLPAFAGLHIEILDENNQSPYFTMPSYQGY

ILESAPVGATISDSLNLTSPLRIVALDKDIEDTKDPELHLFLNDYTSVFTV

TQTGITRYLTLLQPVDREEQQTYTFSITAFDGVQESEPVIVNIQVMDANDN

APVFDPYLPRNLSVVEEEANAFVGQVKATDPDAGINGQVHYSLGNFNNLFR

ITSNGSIYTAVKLNREVRDYYELVVVATDGAVHPRHSTLTLAIKVLDIDDN

SPVFTNSTYTVLVEENLPAGTTILQIEAKDVDLGANVSYRIRSPEVKHFFA

LHPFTGELSLLRSLDYEAFPDQEASITFLVEAFDIYGTMPPGIATVTVIVK

DMNDYPPVFQKKFYIGGVSEDARMFTSVLRVKATDKDTGNYSVMAYRLIIP

PIKEGKEGFVVETYTGLIKTAMLFHNMRRSYFKFQVIATDDYGKGLSGKAD

VLVSVVNQLDMQVIVSNVPPTLVEKKIEDLTEILDRYVQEQIPGAKVVVES

IGARRHGDAFSLEDYTKCDLTVYAIDPQTNRAIDRNELFKFLDGKLLDINK

DFQPYYGEGGRILEIRTPEAVTSIKKRGESLGYTEGALLALAFIIILCCIP

AILVVLVSYRQFKVRQAECTKTARIQAALPAAKPAVPAPAPVAAPPPPPPP

PPGAHLYEELGDSSMHNLFLLYHFQQSRGNNSVSEDRKHQQVVMPFSSNTI
```

-continued
```
EAHKSAHVDGSLKSNKLKSARKFTFLSDEDDLSAHNPLYKENISQVSTNSD

ISQRTDFVDPFSPKIQAKSKSLRGPREKIQRLWSQSVSLPRRLMRKVPNRP

EIIDLQQWQGTRQKAENENTGICTNKRGSSNPLLTTEEANLTEKEEIRQGE

TLMIEGTEQLKSLSSDSSFCFPRPHFSFSTLPTVSRTVELKSEPNVISSPA

ECSLELSPSRPCVLHSSLSRRETPICMLPIETERNIFENFAHPPNISPSAC

PLPPPPPISPPSPPPAPAPLAPPPDISPFSLFCPPPSPPSIPLPLPPPTFF

PLSVSTSGPPTPPLLPPFPTPLPPPPPSIPCPPPPSASFLSTECVCITGVK

CTTNLMPAEKIKSSMTQLSTTTVCKTDPQREPKGILRHVKNLAELEKSVAN

MYSQIEKNYLRTNVSELQTMCPSEVTNMEITSEQNKGSLNNIVEGTEKQSH

SQSTSL
```

An exemplary amino acid sequence of a mini-PCDH15 lacking EC5, EC6, EC9 and EC10 (V6) is set forth in SEQ ID NO: 91 (mini-PCDH15 V6: includes EC1-EC2-EC3-EC4-EC7-EC8-EC11-MAD12-TM-cyto CD2; different domains alternating in bold and regular font):

(SEQ ID NO: 91)
```
MFRQFYLWTCLASGIILGSLFEICLGQYDDDWQYEDCKLARGGPPATIVAI

DEESRNGTILVDNMLIKGTAGGPDPTIELSLKDNVDYWVLMDPVKQMLFLN

STGRVLDRDPPMNIHSIVVQVQCINKKVGTIIYHEVRIVVRDRNDNSPTFK

HESYYATVNELTPVGTTIFTGFSGDNGATDIDDGPNGQIEYVIQYNPDDPT

SNDTFEIPLMLTGNIVLRKRLNYEDKTRYFVIIQANDRAQNLNERRTTTTT

LTVDVLDGDDLGPMFLPCVLVPNTRDCRPLTYQAAIPELRTPEELNPIIVT

PPIQAIDQDRNIQPPSDRPGILYSILVGTPEDYPRFFHMHPRTAELSLLEP

VNRDFHQKFDLVIKAEQDNGHPLPAFAGLHIEILDENNQSPYFTMPSYQGY

ILESAPVGATISDSLNLTSPLRIVALDKDIEDTKDPELHLFLNDYTSVFTV

TQTGITRYLTLLQPVDREEQQTYTFSITAFDGVQESEPVIVNIQVMDANDN

APVFDPYLPRNLSVVEEEANAFVGQVKATDPDAGINGQVHYSLGNFNNLFR

ITSNGSIYTAVKLNREVRDYYELVVVATDGAVHPRHSTLTLAIKVLDIDDN

SPVFTNSTYTVLVEENLPAGTTILQIEAKDVDLGANVSYRIRSPEVKHFFA

LHPFTGELSLLRSLDYEAFPDQEASITFLVEAFDIYGTMPPGIATVTVIVK

DMNDYPPVFQKKFYIGGVSEDARMFTSVLRVKATDKDTGNYSVMAYRLIIP

PIKEGKEGFVVETYTGLIKTAMLFHNMRRSYFKFQVIATDDYGKGLSGKAD

VLVSVVNQLDMQVIVSNVPPTLVEKKIEDLTEILDRYVQEQIPGAKVVVES
```

-continued

IGARRHGDAFSLEDYTKCDLTVYAIDPQTNRAIDRNELFKFLDGKLLDINK

DFQPYYGEGGRILEIRTPEAVTSIKKRGESLGYTEGALLALAFIIILCCIP

AILVVLVSYRQFKVRQAECTKTARIQAALPAAKPAVPAPAPVAAPPPPPPP

PPGAHLYEELGDSSMHKYEMPQYGSRRRLLPPAGQEEYGEVVGEAEEEYEE

EEEEPKKIKKPKVEIREPSEEEEVVVTIEKPPAAEPTYTTWKRARIFPMIF

KKVRGLADKRGIVDLEGEEWQRRLEEEDKDYLKLTLDQEEATESTVESEEE

SSSDYTEYSEEESEFSESETTEEESESETPSEEEESSTPESEESESTESEG

EKARKNIVLARRRPMVEEVKEVKGRKEEPQEEQKEPKMEEEEHSEEEESGP

APVEESTDPEAQDIPEEGSAESASVEGGVESEEESESGSSSSSSSESQSGGP

WGYQVPAYDRSKNANQKKSPGANSEGYNTAL

An exemplary amino acid sequence of a mini-PCDH15 lacking EC5, EC6, EC9 and EC10 (V6) is set forth in SEQ ID NO: 92 (mini-PCDH15 V6: includes EC1-EC2-EC3-EC4-EC7-EC8-EC11-MAD12-TM-cyto CD3; different domains alternating in bold and regular font):

(SEQ ID NO: 92)

MFRQFYLWTCLASGIILGSLFEICLGQYDDDWQYEDCKLARGGPPATIVAI

DEESRNGTILVDNMLIKGTAGGPDPTIELSLKDNVDYWVLMDPVKQMLFLN

STGRVLDRDPPMNIHSIVVQVQCINKKVGTIIYHEVRIVVRDRNDNSPTFK

HESYYATVNELTPVGTTIFTGFSGDNGATDIDDGPNGQIEYVIQYNPDDPT

SNDTFEIPLMLTGNIVLRKRLNYEDKTRYFVIIQANDRAQNLNERRTTTTT

LTVDVLDGDDLGPMFLPCVLVPNTRDCRPLTYQAAIPELRTPEELNPIIVT

-continued

PPIQAIDQDRNIQPPSDRPGILYSILVGTPEDYPRFFHMHPRTAELSLLEP

VNRDFHQKFDLVIKAEQDNGHPLPAFAGLHIEILDENNQSPYFTMPSYQGY

ILESAPVGATISDSLNLTSPLRIVALDKDIEDTKDPELHLFLNDYTSVFTV

TQTGITRYLTLLQPVDREEQQTYTFSITAFDGVQESEPVIVNIQVMDANDN

APVFDPYLPRNLSVVEEEANAFVGQVKATDPDAGINGQVHYSLGNFNNLFR

ITSNGSIYTAVKLNREVRDYYELVVVATDGAVHPRHSTLTLAIKVLDIDDN

SPVFTNSTYTVLVEENLPAGTTILQIEAKDVDLGANVSYRIRSPEVKHFFA

LHPFTGELSLLRSLDYEAFPDQEASITFLVEAFDIYGTMPPGIATVTVIVK

DMNDYPPVFQKKFYIGGVSEDARMFTSVLRVKATDKDTGNYSVMAYRLIIP

PIKEGKEGFVVETYTGLIKTAMLFHNMRRSYFKFQVIATDDYGKGLSGKAD

VLVSVVNQLDMQVIVSNVPPTLVEKKIEDLTEILDRYVQEQIPGAKVVVES

IGARRHGDAFSLEDYTKCDLTVYAIDPQTNRAIDRNELFKFLDGKLLDINK

DFQPYYGEGGRILEIRTPEAVTSIKKRGESLGYTEGALLALAFIIILCCIP

AILVVLVSYRQFKVRQAECTKTARIQAALPAAKPAVPAPAPVAAPPPPPPP

PPGAHLYEELGDSSMHKYEMPQYGSRRRLLPPAGQEEYGEVVGEAEEEYEE

EEWARKRMIKLVVDREYETSSTGEDSAPECQRNRLHHPSIHSNINGNIYIA

QNGSVVRTRRACLTDNLKVASPVRLGGPFKKLDKLAVTHEENVPLNTLSKG

PFSTEKMNARPTLVTFAPCPVGTDNTAVKPLRNRLKSTVEQESMIDSKNIK

EALEFHSDHTQSDDEELWMGPWNNLHIPMTKL

An exemplary nucleic acid sequence encoding a mini-PCDH15 lacking EC5, EC6, EC9 and EC10 (V6) is set forth in SEQ ID NO: 40 (mini-PCDH15 V6: includes EC1-EC2-EC3-EC4-EC7-EC8-EC11-MAD12-TM-cyto CD1):

(SEQ ID NO: 40)

ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

-continued

```
GGTCTACACATTGAAATACTGGATGAAAACAATCAAAGTCCATATTTTACAATGCCCAGTTATC

AAGGCTATATCCTGGAATCTGCCCCAGTGGGAGCAACCATTTCGGACAGTCTCAATTTGACTTC

ACCTTTAAGAATAGTAGCTCTGGACAAGGACATAGAAGATACAAAAGACCCAGAGCTTCACCTT

TTTCTGAATGACTACACCTCAGTCTTCACCGTCACACAGACTGGTATTACTCGCTACCTCACCT

TACTTCAACCAGTGGACAGGGAAGAACAGCAAACTTACACCTTTTCGATAACAGCATTTGATGG

TGTACAAGAAAGTGAGCCAGTCATCGTCAATATTCAAGTGATGGATGCAAATGATAACGCTCCA

GTGTTTGATCCTTATCTGCCAAGAAATTTATCTGTGGTGGAAGAAGAAGCCAATGCCTTTGTGG

GTCAAGTAAAAGCAACAGACCCTGATGCTGGAATAAATGGTCAAGTGCACTACAGTTTGGGTAA

CTTTAATAATCTTTTTCGTATCACATCCAATGGGAGCATTTACACAGCAGTGAAGCTTAACAGA

GAAGTCAGGGACTACTATGAACTTGTTGTTGTGGCAACAGATGGAGCAGTACACCCTCGTCATT

CAACTCTAACCTTGGCCATCAAGGTTTTGGACATTGATGATAACAGTCCTGTGTTCACCAATTC

AACATACACTGTCCTTGTTGAAGAGAATTTGCCAGCTGGGACTACCATCCTTCAAATAGAGGCC

AAAGATGTCGACCTTGGAGCAAATGTGTCTTACCGGATAAGAAGCCCAGAAGTGAAGCACTTTT

TTGCACTACATCCATTTACAGGAGAACTATCGCTTTTAAGGAGTTTAGATTATGAGGCATTTCC

AGACCAAGAAGCAAGTATCACTTTTCTGGTAGAGGCCTTTGATATTTATGGAACAATGCCACCT

GGTATTGCTACTGTCACAGTGATTGTAAAGGATATGAATGATTATCCCCCAGTGTTTCAGAAAA

AATTCTACATCGGAGGTGTATCTGAAGATGCAAGAATGTTTACTTCTGTACTCAGAGTGAAGGC

TACTGATAAAGATACTGGCAATTATAGTGTCATGGCCTACAGACTCATAATACCACCAATTAAA

GAGGGAAAAGAAGGATTTGTAGTGGAAACATATACAGGGCTTATCAAAACTGCTATGCTCTTCC

ATAATATGAGGAGATCCTACTTCAAGTTTCAAGTTATTGCAACTGACGACTATGGGAAGGGACT

GAGCGGCAAAGCCGATGTACTCGTCTCCGTGGTCAATCAGCTGGATATGCAAGTCATTGTTTCC

AATGTGCCTCCTACTCTAGTGGAAAAAAAGATAGAAGATCTTACAGAGATCTTGGATCGCTATG

TTCAGGAACAAATTCCTGGTGCCAAGGTCGTAGTGGAGTCCATTGGAGCTCGCCGGCATGGAGA

TGCCTTTTCCCTAGAAGATTACACCAAATGTGACTTGACTGTCTATGCAATTGACCCCCAAACC

AACAGAGCCATCGATAGAAATGAGCTTTTTAAATTTTTGGATGGCAAACTACTTGATATCAATA

AAGACTTTCAGCCGTATTATGGGGAAGGAGGACGCATTCTGGAGATCCGGACTCCAGAGGCAGT

GACCAGCATTAAAAAGAGAGGAGAAAGTCTAGGATACACAGAAGGGGCCTTGTTGGCTCTGGCC

TTCATCATCATCCTCTGCTGCATTCCTGCCATCTTGGTGGTTTTGGTCAGCTACAGACAGTTTA

AAGTACGTCAAGCTGAGTGTACAAAGACTGCACGAATTCAGGCCGCATTACCCGCGGCTAAACC

AGCAGTGCCGGCTCCTGCACCAGTGGCAGCGCCCCCGCCGCCGCCGCCGCCTCCGCCAGGTGCG

CATCTCTATGAAGAACTTGGAGACAGCTCAATGCATAATCTTTTCCTTCTCTACCATTTTCAAC

AAAGCAGGGGAAATAACTCAGTCTCAGAAGACAGGAAACATCAACAAGTTGTGATGCCCTTTTC

TTCCAATACTATTGAGGCTCACAAGTCAGCTCATGTAGACGGATCACTTAAGAGCAACAAACTG

AAGTCTGCAAGAAAATTCACATTTCTATCTGATGAGGATGACTTAAGTGCCCATAATCCCCTTT

ATAAGGAAAACATAAGTCAAGTATCAACAAATTCAGACATTTCACAGAGAACAGATTTTGTAGA

CCCATTTTCACCCAAAATACAAGCCAAGAGTAAGTCTCTGAGGGGCCCAAGAGAAAAGATTCAG

AGGCTGTGGAGTCAGTCAGTCAGCTTACCCAGGAGGCTGATGAGGAAAGTTCCAAATAGACCAG

AGATCATAGATCTGCAGCAGTGGCAAGGCACCAGGCAGAAAGCTGAAAATGAAAACACTGGAAT

CTGTACAAACAAAAGAGGTAGCAGCAATCCATTGCTTACAACTGAAGAGGCAAATTTGACAGAG

AAAGAGGAAATAAGGCAAGGTGAAACACTGATGATAGAAGGAACAGAACAGTTGAAATCTCTCT
```

-continued

```
CTTCAGACTCTTCATTTTGCTTTCCCAGGCCTCACTTCTCATTCTCCACTTTGCCAACTGTTTC

AAGAACTGTGGAACTCAAATCAGAACCTAATGTCATCAGTTCTCCTGCTGAGTGTTCCTTGGAA

CTTTCTCCTTCAAGGCCTTGTGTTTTACATTCTTCACTCTCTAGGAGAGAGACACCTATTTGTA

TGTTACCTATTGAAACCGAAAGAAATATTTTTGAAAATTTTGCCCATCCACCAAACATCTCTCC

TTCTGCCTGTCCCCTTCCCCCTCCTCCTCCTATTTCTCCTCCTTCTCCTCCTCCTGCTCCTGCT

CCTCTTGCTCCTCCTCCTGACATTTCTCCTTTTTCTCTTTTTTGTCCTCCTCCCTCTCCTCCTT

CTATCCCTCTTCCTCTTCCTCCTCCTACATTTTTTCCACTTTCCGTTTCAACGTCTGGTCCCCC

AACACCACCTCTTCTACCTCCATTTCCAACTCCTCTTCCTCCACCACCTCCTTCTATTCCTTGC

CCTCCACCTCCTTCAGCTTCATTTCTGTCCACAGAGTGTGTCTGTATAACAGGTGTTAAATGCA

CGACCAACTTGATGCCTGCCGAGAAAATTAAGTCCTCTATGACACAGCTATCAACAACGACAGT

GTGTAAAACAGACCCTCAGAGAGAACCAAAAGGCATCCTCAGACACGTTAAAAACTTAGCAGAA

CTTGAAAAATCAGTAGCTAACATGTACAGTCAAATAGAAAAAAACTATCTACGCACAAATGTTT

CAGAACTTCAAACTATGTGCCCTTCAGAAGTAACAAATATGGAAATCACATCTGAACAAACAA

GGGGAGTTTGAACAATATTGTCGAGGGAACTGAAAAACAATCTCACAGTCAATCTACTTCACTG

TAA
```

An exemplary nucleic acid sequence encoding a mini-PCDH15 lacking EC5, EC6, EC9 and EC10 (V6) is set forth in SEQ ID NO: 93 (mini-PCDH15 V6: includes EC1-EC2-EC3-EC4-EC7-EC8-EC11-MAD12-TM-cyto CD2):

```
                                                   (SEQ ID NO: 93)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAAGTCCATATTTTACAATGCCCAGTTATC

AAGGCTATATCCTGGAATCTGCCCCAGTGGGAGCAACCATTTCGGACAGTCTCAATTTGACTTC

ACCTTTAAGAATAGTAGCTCTGGACAAGGACATAGAAGATACAAAAGACCCCAGAGCTTCACCTT

TTTCTGAATGACTACACCTCAGTCTTCACCGTCACACAGACTGGTATTACTCGCTACCTCACCT
```

-continued

```
TACTTCAACCAGTGGACAGGGAAGAACAGCAAACTTACACCTTTTCGATAACAGCATTTGATGG

TGTACAAGAAAGTGAGCCAGTCATCGTCAATATTCAAGTGATGGATGCAAATGATAACGCTCCA

GTGTTTGATCCTTATCTGCCAAGAAATTTATCTGTGGTGGAAGAAGAAGCCAATGCCTTTGTGG

GTCAAGTAAAAGCAACAGACCCTGATGCTGGAATAAATGGTCAAGTGCACTACAGTTTGGGTAA

CTTTAATAATCTTTTTCGTATCACATCCAATGGGAGCATTTACACAGCAGTGAAGCTTAACAGA

GAAGTCAGGGACTACTATGAACTTGTTGTTGTGGCAACAGATGGAGCAGTACACCCTCGTCATT

CAACTCTAACCTTGGCCATCAAGGTTTTGGACATTGATGATAACAGTCCTGTGTTCACCAATTC

AACATACACTGTCCTTGTTGAAGAGAATTTGCCAGCTGGGACTACCATCCTTCAAATAGAGGCC

AAAGATGTCGACCTTGGAGCAAATGTGTCTTACCGGATAAGAAGCCCAGAAGTGAAGCACTTTT

TTGCACTACATCCATTTACAGGAGAACTATCGCTTTTAAGGAGTTTAGATTATGAGGCATTTCC

AGACCAAGAAGCAAGTATCACTTTTCTGGTAGAGGCCTTTGATATTTATGGAACAATGCCACCT

GGTATTGCTACTGTCACAGTGATTGTAAAGGATATGAATGATTATCCCCCAGTGTTTCAGAAAA

AATTCTACATCGGAGGTGTATCTGAAGATGCAAGAATGTTTACTTCTGTACTCAGAGTGAAGGC

TACTGATAAAGATACTGGCAATTATAGTGTCATGGCCTACAGACTCATAATACCACCAATTAAA

GAGGGAAAAGAAGGATTTGTAGTGGAAACATATACAGGGCTTATCAAAACTGCTATGCTCTTCC

ATAATATGAGGAGATCCTACTTCAAGTTTCAAGTTATTGCAACTGACGACTATGGGAAGGGACT

GAGCGGCAAAGCCGATGTACTCGTCTCCGTGGTCAATCAGCTGGATATGCAAGTCATTGTTTCC

AATGTGCCTCCTACTCTAGTGGAAAAAAAGATAGAAGATCTTACAGAGATCTTGGATCGCTATG

TTCAGGAACAAATTCCTGGTGCCAAGGTCGTAGTGGAGTCCATTGGAGCTCGCCGGCATGGAGA

TGCCTTTTCCCTAGAAGATTACACCAAATGTGACTTGACTGTCTATGCAATTGACCCCCAAACC

AACAGAGCCATCGATAGAAATGAGCTTTTTAAATTTTTGGATGGCAAACTACTTGATATCAATA

AAGACTTTCAGCCGTATTATGGGGAAGGAGGACGCATTCTGGAGATCCGGACTCCAGAGGCAGT

GACCAGCATTAAAAAGAGAGGAGAAAGTCTAGGATACACAGAAGGGGCCTTGTTGGCTCTGGCC

TTCATCATCATCCTCTGCTGCATTCCTGCCATCTTGGTGGTTTTGGTCAGCTACAGACAGTTTA

AAGTACGTCAAGCTGAGTGTACAAAGACTGCACGAATTCAGGCCGCATTACCCGCGGCTAAACC

AGCAGTGCCGGCTCCTGCACCAGTGGCAGCGCCCCCGCCGCCGCCGCCGCCTCCGCCAGGTGCG

CATCTCTATGAAGAACTTGGAGACAGCTCAATGCATAAGTATGAAATGCCTCAATATGGGAGTC

GCCGTCGATTGTTACCACCAGCTGGACAGGAGGAATATGGTGAGGTGGTTGGTGAAGCTGAGGA

AGAATATGAGGAGGAAGAGGAAGAGCCAAAGAAAATTAAAAAACCAAAGGTTGAAATTAGAGAG

CCTAGTGAGGAGGAAGAAGTAGTTGTAACTATCGAAAAACCACCAGCAGCTGAGCCTACATACA

CAACATGGAAGAGAGCCAGAATATTCCCCATGATTTTTAAGAAAGTTAGAGGATTAGCTGATAA

AAGAGGAATCGTTGACCTTGAGGGTGAAGAGTGGCAGAGACGCCTTGAGGAAGAAGATAAAGAT

TATTTGAAACTCACTCTGGACCAAGAGGAAGCAACAGAAAGCACTGTAGAATCAGAGGAGGAAT

CCTCCAGCGACTATACTGAATACAGTGAAGAAGAGTCTGAGTTCAGTGAGTCTGAGACTACAGA

AGAGGAATCTGAGTCAGAGACACCCTCTGAGGAGGAGGAGAGTTCCACCCCTGAATCAGAAGAA

TCGGAATCCACAGAGTCAGAAGGAGAAAAAGCAAGGAAAAACATTGTGCTTGCAAGAAGAAGGC

CCATGGTTGAGGAGGTCAAGGAAGTCAAGGGTAGGAAAGAGGAGCCACAAGAAGAACAAAAAGA

ACCTAAGATGGAAGAAGAAGAACACTCAGAAGAAGAAGAAAGTGGACCAGCCCCTGTGGAAGAA

AGTACAGACCCTGAAGCTCAAGATATCCCTGAAGAGGGCAGTGCAGAATCAGCTTCGGTGGAAG
```

-continued
GAGGTGTGGAAAGTGAGGAGGAATCAGAATCAGGTAGTAGTAGCAGTAGTAGCGAAAGTCAGTC

TGGAGGTCCATGGGGCTATCAGGTACCAGCGTATGACAGAAGCAAGAATGCAAACCAAAAGAAG

TCGCCAGGAGCAAACTCTGAAGGTTACAACACAGCACTTTGA

An exemplary nucleic acid sequence encoding a mini-PCDH15 lacking EC5, EC6, EC9 and EC10 (V6) is set forth in SEQ ID NO: 94 (mini-PCDH15 V6: includes EC1-EC2-EC3-EC4-EC7-EC8-EC11-MAD12-TM-cyto CD3):

(SEQ ID NO: 94)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAAGTCCATATTTTACAATGCCCAGTTATC

AAGGCTATATCCTGGAATCTGCCCCAGTGGGAGCAACCATTTCGGACAGTCTCAATTTGACTTC

ACCTTTAAGAATAGTAGCTCTGGACAAGGACATAGAAGATACAAAAGACCCAGAGCTTCACCTT

TTTCTGAATGACTACACCTCAGTCTTCACCGTCACACAGACTGGTATTACTCGCTACCTCACCT

TACTTCAACCAGTGGACAGGGAAGAACAGCAAACTTACACCTTTTCGATAACAGCATTTGATGG

TGTACAAGAAAGTGAGCCAGTCATCGTCAATATTCAAGTGATGGATGCAAATGATAACGCTCCA

GTGTTTGATCCTTATCTGCCAAGAAATTTATCTGTGGTGGAAGAAGAAGCCAATGCCTTTGTGG

GTCAAGTAAAAGCAACAGACCCTGATGCTGGAATAAATGGTCAAGTGCACTACAGTTTGGGTAA

CTTTAATAATCTTTTTCGTATCACATCCAATGGGAGCATTTACACAGCAGTGAAGCTTAACAGA

GAAGTCAGGGACTACTATGAACTTGTTGTTGTGGCAACAGATGGAGCAGTACACCCTCGTCATT

CAACTCTAACCTTGGCCATCAAGGTTTTGGACATTGATGATAACAGTCCTGTGTTCACCAATTC

AACATACACTGTCCTTGTTGAAGAGAATTTGCCAGCTGGGACTACCATCCTTCAAATAGAGGCC

AAAGATGTCGACCTTGGAGCAAATGTGTCTTACCGGATAAGAAGCCCAGAAGTGAAGCACTTTT

TTGCACTACATCCATTTACAGGAGAACTATCGCTTTTAAGGAGTTTAGATTATGAGGCATTTCC

AGACCAAGAAGCAAGTATCACTTTTCTGGTAGAGGCCTTTGATATTTATGGAACAATGCCACCT

GGTATTGCTACTGTCACAGTGATTGTAAAGGATATGAATGATTATCCCCCAGTGTTTCAGAAAA

-continued

```
AATTCTACATCGGAGGTGTATCTGAAGATGCAAGAATGTTTACTTCTGTACTCAGAGTGAAGGC

TACTGATAAAGATACTGGCAATTATAGTGTCATGGCCTACAGACTCATAATACCACCAATTAAA

GAGGGAAAAGAAGGATTTGTAGTGGAAACATATACAGGGCTTATCAAAACTGCTATGCTCTTCC

ATAATATGAGGAGATCCTACTTCAAGTTTCAAGTTATTGCAACTGACGACTATGGGAAGGGACT

GAGCGGCAAAGCCGATGTACTCGTCTCCGTGGTCAATCAGCTGGATATGCAAGTCATTGTTTCC

AATGTGCCTCCTACTCTAGTGGAAAAAAAGATAGAAGATCTTACAGAGATCTTGGATCGCTATG

TTCAGGAACAAATTCCTGGTGCCAAGGTCGTAGTGGAGTCCATTGGAGCTCGCCGGCATGGAGA

TGCCTTTTCCCTAGAAGATTACACCAAATGTGACTTGACTGTCTATGCAATTGACCCCCAAACC

AACAGAGCCATCGATAGAAATGAGCTTTTTAAATTTTTGGATGGCAAACTACTTGATATCAATA

AAGACTTTCAGCCGTATTATGGGGAAGGAGGACGCATTCTGGAGATCCGGACTCCAGAGGCAGT

GACCAGCATTAAAAAGAGAGGAGAAAGTCTAGGATACACAGAAGGGGCCTTGTTGGCTCTGGCC

TTCATCATCATCCTCTGCTGCATTCCTGCCATCTTGGTGGTTTTGGTCAGCTACAGACAGTTTA

AAGTACGTCAAGCTGAGTGTACAAAGACTGCACGAATTCAGGCCGCATTACCCGCGGCTAAACC

AGCAGTGCCGGCTCCTGCACCAGTGGCAGCGCCCCCGCCGCCGCCGCCGCCTCCGCCAGGTGCG

CATCTCTATGAAGAACTTGGAGACAGCTCAATGCATAAGTATGAAATGCCTCAATATGGGAGTC

GCCGTCGATTGTTACCACCAGCTGGACAGGAGGAATATGGTGAGGTGGTTGGTGAAGCTGAGGA

AGAATATGAGGAGGAAGAGTGGGCAAGAAAAAGAATGATCAAGTTAGTTGTTGATCGAGAGTAT

GAAACCAGCTCAACTGGAGAAGACAGTGCTCCTGAATGTCAGAGAAACCGTCTTCACCATCCTA

GTATCCACAGTAATATCAACGGCAATATATATATTGCACAGAATGGTTCTGTGGTGAGAACCCG

CCGTGCCTGCCTCACGGACAACTTAAAAGTTGCTTCCCCTGTTCGACTGGGAGGGCCCTTTAAG

AAACTAGACAAGTTGGCAGTGACACATGAGGAGAATGTACCTCTGAACACATTATCAAAGGGGC

CATTTTCTACTGAAAAAATGAATGCAAGACCAACTCTGGTTACATTTGCCCCTTGCCCTGTGGG

GACTGACAATACAGCGGTGAAGCCACTAAGGAACAGGCTGAAAAGCACAGTTGAACAGGAGTCC

ATGATTGACAGTAAGAACATCAAGGAGGCTTTGGAATTTCATAGTGACCACACACAGTCTGATG

ATGAAGAGCTTTGGATGGGCCCCTGGAACAACCTCCATATACCAATGACAAAACTGTGA
```

In some embodiments, the mini-PCDH15 has 5 EC domains less than the full-length PCDH15. In some examples, the mini-PCDH15 lacks EC4, EC5, EC6, EC7 and EC8 domain. In some embodiments, the mini-PCDH15 includes EC1-EC2-EC3-EC9-EC10-EC11 of SEQ ID NO: 1, 53, 55, or 57. In one example, the mini-PCDH15 comprises an amino acid sequence at least 60%, 70%, 75%, 80%, 85%, 90%, 91%, 92%, 93%, 94%, 95%, 96%, 97%, 98%, 99% or 100% identical to SEQ ID NO: 41, 95, or 96. In some embodiments, the nucleic acid encoding the mini- PCDH15 lacking EC4, EC5, EC6, EC7 and EC8 is at least 60%, 70%, 75%, 80%, 85%, 90%, 91%, 92%, 93%, 94%, 95%, 96%, 97%, 98%, 99% or 100% identical to SEQ ID NO: 42, 97, or 98.

An exemplary amino acid sequence of a mini-PCDH15 lacking EC4, EC5, EC6, EC7 and EC8 (V4) is set forth in SEQ ID NO: 41 (mini-PCDH15 V4: includes EC1-EC2-EC3-EC9-EC10-EC1-MAD12-TM-cyto CD1; different domains alternating in bold and regular font):

```
                                              (SEQ ID NO: 41)
MFRQFYLWTCLASGTTLGSLFEICLGQYDDDWQYEDCKLARGGPPATTVAIDEESRNGTTLVDN

MLIKGTAGGPDPTTELSLKDNVDYWVLMDPVKQMLFLNSTGRVLDRDPPMNIHSIVVQVQCTNK

KVGTTIYHEVRIVVRDRNDNSPTFKHESYYATVNELTPVGTTTFTGFSGDNGATDIDDGPNGQI

EYVIQYNPDDPTSNDTFEIPLMLTGNIVLRKRLNYEDKTRYFVIIQANDRAQNLNERRTTTTTL

TVDVLDGDDLGPMFLPCVLVPNTRDCRPLTYQAAIPELRTPEELNPIIVTPPIQAIDQDRNIQP

PSDRPGTLYSILVGTPEDYPRFFHMHPRTAELSLLEPVNRDFHQKFDLVIKAEQDNGHPLPAFA

GLHIEILDENNQPPVFSKRIYKGMVAPDAVKGTPITTVYAEDADPPGLPASRVRYRVDDVQFPY

PASIFEVEEDSGRVITRVNLNEEPTTTFKLVVVAFDDGEPVMSSSATVKILVLHPGEIPRFTQE
```

-continued

EYRPPPVSELATKGTMVGVISAAAINQSIVYSIVSGNEEDTFGTNNITGVIYVNGPLDYETRTS

YVLRVQADSLEVVLANLRVPSKSNTAKVYIEIQDENNHPPVFQKKFYIGGVSEDARMFTSVLRV

KATDKDTGNYSVMAYRLIIPPIKEGKEGFVVETYTGLIKTAMLFHNMRRSYFKFQVIATDDYGK

GLSGKADVLVSVVNQLDMQVIVSNVPPTLVEKKIEDLTEILDRYVQEQIPGAKVVVESIGARRH

GDAFSLEDYTKCDLTVYAIDPQTNRAIDRNELFKFLDGKLLDINKDFQPYYGEGGRILEIRTPE

AVISIKKRGESLGYTEGALLALAFIIILCCTPAILVVLVSYRQFKVRQAECTKTARIQAALPAA

KPAVPAPAPVAAPPPPPPPPPGAHLYEELGDSSMHNLFLLYHFQQSRGNNSVSEDRKHQQVVMP

FSSNTTEAHKSAHVDGSLKSNKLKSARKFTFLSDEDDLSAHNPLYKENISQVSTNSDISQRTDF

VDPFSPKIQAKSKSLRGPREKIQRLWSQSVSLPRRLMRKVPNRPEIIDLQQWQGTRQKAENENT

GTCTNKRGSSNPLLTTEEANLTEKEEIRQGETLMIEGTEQLKSLSSDSSFCFPRPHFSFSTLPT

VSRTVELKSEPNVISSPAECSLELSPSRPCVLHSSLSRRETPICMLPIETERNIFENFAHPPNI

SPSACPLPPPPPISPPSPPPAPAPLAPPPDISPFSLFCPPPSPPSIPLPLPPPTFFPLSVSTSG

PPTPPLLPPFPTPLPPPPPSIPCPPPPSASFLSTECVCTTGVKCTTNLMPAEKIKSSMTQLSTT

TVCKTDPQREPKGTLRHVKNLAELEKSVANMYSQIEKNYLRTNVSELQTMCPSEVTNMEITSEQ

NKGSLNNIVEGTEKQSHSQSTSL

An exemplary amino acid sequence of a mini-PCDH15 lacking EC4, EC5, EC6, EC7 and EC8 (V4) is set forth in SEQ ID NO: 95 (mini-PCDH15 V4: includes EC1-EC2-EC3-EC9-EC10-EC1-MAD12-TM-cyto CD2; different domains alternating in bold and regular font):

An exemplary amino acid sequence of a miniPCDH15 lacking EC4, EC5, EC6, EC7 and EC8 (V4) is set forth in SEQ ID NO: 96 (mini-PCDH15 V4: includes EC1-EC2-EC3-EC9-EC10-EC11-MAD12-TM-cyto CD3; different domains alternating in bold and regular font):

(SEQ ID NO: 95)
MFRQFYLWTCLASGTTLGSLFEICLGQYDDDWQYEDCKLARGGPPATTVAIDEESRNGTTLVDN

MLIKGTAGGPDPTTELSLKDNVDYWVLMDPVKQMLFLNSTGRVLDRDPPMNIHSIVVQVQCTNK

KVGTTIYHEVRIVVRDRNDNSPTFKHESYYATVNELTPVGTTTFTGFSGDNGATDIDDGPNGQI

EYVIQYNPDDPTSNDTFEIPLMLTGNIVLRKRLNYEDKTRYFVIIQANDRAQNLNERRTTTTTL

TVDVLDGDDLGPMFLPCVLVPNTRDCRPLTYQAAIPELRTPEELNPIIVTPPIQAIDQDRNIQP

PSDRPGTLYSILVGTPEDYPRFFHMHPRTAELSLLEPVNRDFHQKFDLVIKAEQDNGHPLPAFA

GLHIEILDENNQPPVFSKRIYKGMVAPDAVKGTPITTVYAEDADPPGLPASRVRYRVDDVQFPY

PASIFEVEEDSGRVITRVNLNEEPTTTFKLVVVAFDDGEPVMSSSATVKILVLHPGEIPRFTQE

EYRPPPVSELATKGTMVGVISAAAINQSIVYSIVSGNEEDTFGTNNITGVIYVNGPLDYETRTS

YVLRVQADSLEVVLANLRVPSKSNTAKVYIEIQDENNHPPVFQKKFYIGGVSEDARMFTSVLRV

KATDKDTGNYSVMAYRLIIPPIKEGKEGFVVETYTGLIKTAMLFHNMRRSYFKFQVIATDDYGK

GLSGKADVLVSVVNQLDMQVIVSNVPPTLVEKKIEDLTEILDRYVQEQIPGAKVVVESIGARRH

GDAFSLEDYTKCDLTVYAIDPQTNRAIDRNELFKFLDGKLLDINKDFQPYYGEGGRILEIRTPE

AVISIKKRGESLGYTEGALLAFLAFIIILCCTPAILVVLVSYRQFKVRQAECTKTARIQAALPA

AKPAVPAPAPVAAPPPPPPPPPGAHLYEELGDSSMHKYEMPQYGSRRRLLPPAGQEEYGEVVGE

AEEEYEEEEEEPKKIKKPKVEIREPSEEEEVVVTTEKPPAAEPTYTTWKRARIFPMIFKKVRGL

ADKRGTVDLEGEEWQRRLEEEDKDYLKLTLDQEEATESTVESEEESSSDYTEYSEEESEFSESE

TTEEESESETPSEEEESSTPESEESESTESEGEKARKNIVLARRRPMVEEVKEVKGRKEEPQEE

QKEPKMEEEEHSEEEESGPAPVEESTDPEAQDIPEEGSAESASVEGGVESEEEESESGSSSSSE

SQSGGPWGYQVPAYDRSKNANQKKSPGANSEGYNTAL (SEQ ID NO: 96)
MFRQFYLWTCLASGTTLGSLFEICLGQYDDDWQYEDCKLARGGPPATTVAIDEESRNGTTLVDN

MLIKGTAGGPDPTTELSLKDNVDYWVLMDPVKQMLFLNSTGRVLDRDPPMNIHSIVVQVQCTNK

KVGTTIYHEVRIVVRDRNDNSPTFKHESYYATVNELTPVGTTTFTGFSGDNGATDIDDGPNGQI

EYVIQYNPDDPTSNDTFEIPLMLTGNIVLRKRLNYEDKTRYFVIIQANDRAQNLNERRTTTTTL

TVDVLDGDDLGPMFLPCVLVPNTRDCRPLTYQAAIPELRTPEELNPIIVTPPIQAIDQDRNIQP

PSDRPGTLYSILVGTPEDYPRFFHMHPRTAELSLLEPVNRDFHQKFDLVIKAEQDNGHPLPAFA

GLHIEILDENNQPPVFSKRIYKGMVAPDAVKGTPITTVYAEDADPPGLPASRVRYRVDDVQFPY

PASIFEVEEDSGRVITRVNLNEEPTTTFKLVVVAFDDGEPVMSSSATVKILVLHPGEIPRFTQE

EYRPPPVSELATKGTMVGVISAAAINQSIVYSIVSGNEEDTFGTNNITGVIYVNGPLDYETRTS

YVLRVQADSLEVVLANLRVPSKSNTAKVYIEIQDENNHPPVFQKKFYIGGVSEDARMFTSVLRV

KATDKDTGNYSVMAYRLIIPPIKEGKEGFVVETYTGLIKTAMLFHNMRRSYFKFQVIATDDYGK

GLSGKADVLVSVVNQLDMQVIVSNVPPTLVEKKIEDLTEILDRYVQEQIPGAKVVVESIGARRH

GDAFSLEDYTKCDLTVYAIDPQTNRAIDRNELFKFLDGKLLDINKDFQPYYGEGGRILEIRTPE

AVISIKKRGESLGYTEGALLALAFIIILCCTPAILVVLVSYRQFKVRQAECTKTARIQAALPAA

KPAVPAPAPVAAPPPPPPPPPGAHLYEELGDSSMHKYEMPQYGSRRRLLPPAGQEEYGEVVGEA

EEEYEEEEWARKRMIKLVVDREYETSSTGEDSAPECQRNRLHHPSIHSNINGNIYIAQNGSVVR

TRRACLTDNLKVASPVRLGGPFKKLDKLAVTHEENVPLNTLSKGPFSTEKMNARPTLVTFAPCP

VGTDNTAVKPLRNRLKSTVEQESMIDSKNIKEALEFHSDHTQSDDEELWMGPWNNLHIPMTKL

An exemplary nucleic acid sequence encoding a mini-PCDH15 lacking EC4, EC5, EC6, EC7 and EC8 (V4) is set forth in SEQ ID NO: 42 (mini-PCDH15 V4: includes EC1-EC2-EC3-EC9-EC10-EC11-MAD12-TM-cytoCD1):

(SEQ ID NO: 42)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAACCTCCTGTCTTTAGTAAACGAATATACA

-continued

```
AAGGGATGGTGGCTCCGGATGCAGTCAAGGGTACACCTATCACAACAGTTTATGCTGAAGATGC

AGACCCTCCTGGATTACCTGCAAGTCGTGTGAGGTATAGAGTAGATGATGTACAGTTTCCTTAC

CCTGCCAGTATTTTTGAAGTGGAAGAAGATTCTGGAAGAGTAATAACACGAGTCAATCTTAATG

AAGAACCTACAACAATTTTTAAGTTGGTGGTGGTTGCTTTTGATGATGGGGAGCCTGTGATGTC

CAGCAGTGCCACAGTGAAGATTCTTGTCTTACATCCTGGTGAGATCCCACGCTTCACACAGGAG

GAATATAGACCTCCTCCAGTAAGTGAACTTGCCACCAAAGGGACCATGGTTGGTGTAATTTCTG

CTGCTGCCATTAATCAAAGTATTGTGTACTCCATTGTTTCAGGAAATGAAGAAGATACATTTGG

AATTAATAACATCACAGGTGTTATCTATGTGAATGGACCTCTGGATTATGAGACCAGGACAAGC

TATGTACTTCGAGTCCAAGCTGATTCCCTGGAAGTGGTCCTTGCCAATCTCCGAGTTCCTTCAA

AAAGCAATACAGCTAAAGTATACATTGAGATTCAGGATGAAAATAATCATCCCCCAGTGTTTCA

GAAAAAATTCTACATCGGAGGTGTATCTGAAGATGCAAGAATGTTTACTTCTGTACTCAGAGTG

AAGGCTACTGATAAAGATACTGGCAATTATAGTGTCATGGCCTACAGACTCATAATACCACCAA

TTAAAGAGGGAAAGAAGGATTTGTAGTGGAAACATATACAGGGCTTATCAAAACTGCTATGCT

CTTCCATAATATGAGGAGATCCTACTTCAAGTTTCAAGTTATTGCAACTGACGACTATGGGAAG

GGACTGAGCGGCAAAGCCGATGTACTCGTCTCCGTGGTCAATCAGCTGGATATGCAAGTCATTG

TTTCCAATGTGCCTCCTACTCTAGTGGAAAAAAAGATAGAAGATCTTACAGAGATCTTGGATCG

CTATGTTCAGGAACAAATTCCTGGTGCCAAGGTCGTAGTGGAGTCCATTGGAGCTCGCCGGCAT

GGAGATGCCTTTTCCCTAGAAGATTACACCAAATGTGACTTGACTGTCTATGCAATTGACCCCC

AAACCAACAGAGCCATCGATAGAAATGAGCTTTTTAAATTTTTGGATGGCAAACTACTTGATAT

CAATAAAGACTTTCAGCCGTATTATGGGGAAGGAGGACGCATTCTGGAGATCCGGACTCCAGAG

GCAGTGACCAGCATTAAAAAGAGAGGAGAAAGTCTAGGATACACAGAAGGGGCCTTGTTGGCTC

TGGCCTTCATCATCATCCTCTGCTGCATTCCTGCCATCTTGGTGGTTTTGGTCAGCTACAGACA

GTTTAAAGTACGTCAAGCTGAGTGTACAAAGACTGCACGAATTCAGGCCGCATTACCCGCGGCT

AAACCAGCAGTGCCGGCTCCTGCACCAGTGGCAGCGCCCCCGCCGCCGCCGCCGCCTCCGCCAG

GTGCGCATCTCTATGAAGAACTTGGAGACAGCTCAATGCATAATCTTTTCCTTCTCTACCATTT

TCAACAAAGCAGGGGAAATAACTCAGTCTCAGAAGACAGGAAACATCAACAAGTTGTGATGCCC

TTTTCTTCCAATACTATTGAGGCTCACAAGTCAGCTCATGTAGACGGATCACTTAAGAGCAACA

AACTGAAGTCTGCAAGAAAATTCACATTTCTATCTGATGAGGATGACTTAAGTGCCCATAATCC

CCTTTATAAGGAAAACATAAGTCAAGTATCAACAAATTCAGACATTTCACAGAGAACAGATTTT

GTAGACCCATTTTCACCCAAAATACAAGCCAAGAGTAAGTCTCTGAGGGGCCCAAGAGAAAAGA

TTCAGAGGCTGTGGAGTCAGTCAGTCAGCTTACCCAGGAGGCTGATGAGGAAAGTTCCAAATAG

ACCAGAGATCATAGATCTGCAGCAGTGGCAAGGCACCAGGCAGAAAGCTGAAAATGAAAACACT

GGAATCTGTACAAACAAAAGAGGTAGCAGCAATCCATTGCTTACAACTGAAGAGGCAAATTTGA

CAGAGAAAGAGGAAATAAGGCAAGGTGAAACACTGATGATAGAAGGAACAGAACAGTTGAAATC

TCTCTCTTCAGACTCTTCATTTTGCTTTCCCAGGCCTCACTTCTCATTCTCCACTTTGCCAACT

GTTTCAAGAACTGTGGAACTCAAATCAGAACCTAATGTCATCAGTTCTCCTGCTGAGTGTTCCT

TGGAACTTTCTCCTTCAAGGCCTTGTGTTTTACATTCTTCACTCTCTAGGAGAGAGACACCTAT

TTGTATGTTACCTATTGAAACCGAAAGAAATATTTTTGAAAATTTTGCCCATCCACCAAACATC

TCTCCTTCTGCCTGTCCCCTTCCCCCTCCTCCTCCTATTTCTCCTCCTTCTCCTCCTCCTGCTC

CTGCTCCTCTTGCTCCTCCTCCTGACATTTCTCCTTTTTCTCTTTTTTGTCCTCCTCCCTCTCC
```

-continued

```
TCCTTCTATCCCTCTTCCTCTTCCTCCTCCTACATTTTTTCCACTTTCCGTTTCAACGTCTGGT

CCCCCAACACCACCTCTTCTACCTCCATTTCCAACTCCTC11CCTCCACCACCTCCTTCTATTC

CTTGCCCTCCACCTCCTTCAGCTTCATTTCTGTCCACAGAGTGTGTCTGTATAACAGGTGTTAA

ATGCACGACCAACTTGATGCCTGCCGAGAAAATTAAGTCCTCTATGACACAGCTATCAACAACG

ACAGTGTGTAAAACAGACCCTCAGAGAGAACCAAAAGGCATCCTCAGACACGTTAAAAACTTAG

CAGAACTTGAAAAATCAGTAGCTAACATGTACAGTCAAATAGAAAAAAACTATCTACGCACAAA

TGTTTCAGAACTTCAAACTATGTGCCCTTCAGAAGTAACAAATATGGAAATCACATCTGAACAA

AACAAGGGGAGTTTGAACAATATTGTCGAGGGAACTGAAAAACAATCTCACAGTCAATCTACTT

CACTGTAA
```

An exemplary nucleic acid sequence encoding a mini-PCDH15 lacking EC4, EC5, EC6, EC7 and EC8 (V4) is set forth in SEQ ID NO: 97 (mini-PCDH15 V4: includes EC1-EC2-EC3-EC9-EC10-EC11-MAD12-TM-cytoCD2):

```
                                                        (SEQ ID NO: 97)
ATGTTTCGACAGTTTTATCTCTGGACATGTTTAGCTTCAGGGATCATCCTGGGCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTGGTTATTAAGGCTGAACAAGACAATGGTCATCCTCTTCCTGCCTTTGCC

GGTCTACACATTGAAATACTGGATGAAAACAATCAACCTCCTGTCTTTAGTAAACGAATATACA

AAGGGATGGTGGCTCCGGATGCAGTCAAGGGTACACCTATCACAACAGTTTATGCTGAAGATGC

AGACCCTCCTGGATTACCTGCAAGTCGTGTGAGGTATAGAGTAGATGATGTACAGTTTCCTTAC

CCTGCCAGTATTTTTGAAGTGGAAGAAGATTCTGGAAGAGTAATAACACGAGTCAATCTTAATG

AAGAACCTACAACAATTTTTAAGTTGGTGGTGGTTGCTTTTGATGATGGGGAGCCTGTGATGTC

CAGCAGTGCCACAGTGAAGATTCTTGTCTTACATCCTGGTGAGATCCCACGCTTCACACAGGAG

GAATATAGACCTCCTCCAGTAAGTGAACTTGCCACCAAAGGGACCATGGTTGGTGTAATTTCTG

CTGCTGCCATTAATCAAAGTATTGTGTACTCCATTGTTTCAGGAAATGAAGAAGATACATTTGG

AATTAATAACATCACAGGTGTTATCTATGTGAATGGACCTCTGGATTATGAGACCAGGACAAGC

TATGTACTTCGAGTCCAAGCTGATTCCCTGGAAGTGGTCCTTGCCAATCTCCGAGTTCCTTCAA
```

```
AAAGCAATACAGCTAAAGTATACATTGAGATTCAGGATGAAAATAATCATCCCCCAGTGTTTCA

GAAAAAATTCTACATCGGAGGTGTATCTGAAGATGCAAGAATGTTTACTTCTGTACTCAGAGTG

AAGGCTACTGATAAAGATACTGGCAATTATAGTGTCATGGCCTACAGACTCATAATACCACCAA

TTAAAGAGGGAAAAGAAGGATTTGTAGTGGAAACATATACAGGGCTTATCAAAACTGCTATGCT

CTTCCATAATATGAGGAGATCCTACTTCAAGTTTCAAGTTATTGCAACTGACGACTATGGGAAG

GGACTGAGCGGCAAAGCCGATGTACTCGTCTCCGTGGTCAATCAGCTGGATATGCAAGTCATTG

TTTCCAATGTGCCTCCTACTCTAGTGGAAAAAAAGATAGAAGATCTTACAGAGATCTTGGATCG

CTATGTTCAGGAACAAATTCCTGGTGCCAAGGTCGTAGTGGAGTCCATTGGAGCTCGCCGGCAT

GGAGATGCCTTTTCCCTAGAAGATTACACCAAATGTGACTTGACTGTCTATGCAATTGACCCCC

AAACCAACAGAGCCATCGATAGAAATGAGCTTTTTAAATTTTTGGATGGCAAACTACTTGATAT

CAATAAAGACTTTCAGCCGTATTATGGGGAAGGAGGACGCATTCTGGAGATCCGGACTCCAGAG

GCAGTGACCAGCATTAAAAAGAGAGGAGAAAGTCTAGGATACACAGAAGGGGCCTTGTTGGCTC

TGGCCTTCATCATCATCCTCTGCTGCATTCCTGCCATCTTGGTGGTTTTGGTCAGCTACAGACA

GTTTAAAGTACGTCAAGCTGAGTGTACAAAGACTGCACGAATTCAGGCCGCATTACCCGCGGCT

AAACCAGCAGTGCCGGCTCCTGCACCAGTGGCAGCGCCCCCGCCGCCGCCGCCGCCTCCGCCAG

GTGCGCATCTCTATGAAGAACTTGGAGACAGCTCAATGCATAAGTATGAAATGCCTCAATATGG

GAGTCGCCGTCGATTGTTACCACCAGCTGGACAGGAGGAATATGGTGAGGTGGTTGGTGAAGCT

GAGGAAGAATATGAGGAGGAAGAGGAAGAGCCAAAGAAAATTAAAAAACCAAAGGTTGAAATTA

GAGAGCCTAGTGAGGAGGAAGAAGTAGTTGTAACTATCGAAAAACCACCAGCAGCTGAGCCTAC

ATACACAACATGGAAGAGAGCCAGAATATTCCCCATGATTTTTAAGAAAGTTAGAGGATTAGCT

GATAAAAGAGGAATCGTTGACCTTGAGGGTGAAGAGTGGCAGAGACGCCTTGAGGAAGAAGATA

AAGATTATTTGAAACTCACTCTGGACCAAGAGGAAGCAACAGAAAGCACTGTAGAATCAGAGGA

GGAATCCTCCAGCGACTATACTGAATACAGTGAAGAAGAGTCTGAGTTCAGTGAGTCTGAGACT

ACAGAAGAGGAATCTGAGTCAGAGACACCCTCTGAGGAGGAGGAGAGTTCCACCCCTGAATCAG

AAGAATCGGAATCCACAGAGTCAGAAGGAGAAAAAGCAAGGAAAAACATTGTGCTTGCAAGAAG

AAGGCCCATGGTTGAGGAGGTCAAGGAAGTCAAGGGTAGGAAAGAGGAGCCACAAGAAGAACAA

AAAGAACCTAAGATGGAAGAAGAAGAACACTCAGAAGAAGAAGAAAGTGGACCAGCCCCTGTGG

AAGAAAGTACAGACCCTGAAGCTCAAGATATCCCTGAAGAGGGCAGTGCAGAATCAGCTTCGGT

GGAAGGAGGTGTGGAAAGTGAGGAGGAATCAGAATCAGGTAGTAGTAGCAGTAGTAGCGAAAGT

CAGTCTGGAGGTCCATGGGGCTATCAGGTACCAGCGTATGACAGAAGCAAGAATGCAAACCAAA

AGAAGTCGCCAGGAGCAAACTCTGAAGGTTACAACACAGCACTTTGA
```

An exemplary nucleic acid sequence encoding a mini-PCDH15 lacking EC4, EC5, EC6, EC7 and EC8 (V4) is set forth in SEQ ID NO: 98 (mini-PCDH15 V4: includes EC1-EC2-EC3-EC9-EC10-EC11-MAD12-TM-cytoCD3):

```
                                                    (SEQ ID NO: 98)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA
```

-continued

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAACCTCCTGTCTTTAGTAAACGAATATACA

AAGGGATGGTGGCTCCGGATGCAGTCAAGGGTACACCTATCACAACAGTTTATGCTGAAGATGC

AGACCCTCCTGGATTACCTGCAAGTCGTGTGAGGTATAGAGTAGATGATGTACAGTTTCCTTAC

CCTGCCAGTATTTTTGAAGTGGAAGAAGATTCTGGAAGAGTAATAACACGAGTCAATCTTAATG

AAGAACCTACAACAATTTTTAAGTTGGTGGTGGTTGCTTTTGATGATGGGGAGCCTGTGATGTC

CAGCAGTGCCACAGTGAAGATTCTTGTCTTACATCCTGGTGAGATCCCACGCTTCACACAGGAG

GAATATAGACCTCCTCCAGTAAGTGAACTTGCCACCAAAGGGACCATGGTTGGTGTAATTTCTG

CTGCTGCCATTAATCAAAGTATTGTGTACTCCATTGTTTCAGGAAATGAAGAAGATACATTTGG

AATTAATAACATCACAGGTGTTATCTATGTGAATGGACCTCTGGATTATGAGACCAGGACAAGC

TATGTACTTCGAGTCCAAGCTGATTCCCTGGAAGTGGTCCTTGCCAATCTCCGAGTTCCTTCAA

AAAGCAATACAGCTAAAGTATACATTGAGATTCAGGATGAAAATAATCATCCCCCAGTGTTTCA

GAAAAAATTCTACATCGGAGGTGTATCTGAAGATGCAAGAATGTTTACTTCTGTACTCAGAGTG

AAGGCTACTGATAAAGATACTGGCAATTATAGTGTCATGGCCTACAGACTCATAATACCACCAA

TTAAAGAGGGAAAAGAAGGATTTGTAGTGGAAACATATACAGGGCTTATCAAAACTGCTATGCT

CTTCCATAATATGAGGAGATCCTACTTCAAGTTTCAAGTTATTGCAACTGACGACTATGGGAAG

GGACTGAGCGGCAAAGCCGATGTACTCGTCTCCGTGGTCAATCAGCTGGATATGCAAGTCATTG

TTTCCAATGTGCCTCCTACTCTAGTGGAAAAAAAGATAGAAGATCTTACAGAGATCTTGGATCG

CTATGTTCAGGAACAAATTCCTGGTGCCAAGGTCGTAGTGGAGTCCATTGGAGCTCGCCGGCAT

GGAGATGCCTTTTCCCTAGAAGATTACACCAAATGTGACTTGACTGTCTATGCAATTGACCCCC

AAACCAACAGAGCCATCGATAGAAATGAGCTTTTTAAATTTTTGGATGGCAAACTACTTGATAT

CAATAAAGACTTTCAGCCGTATTATGGGGAAGGAGGACGCATTCTGGAGATCCGGACTCCAGAG

GCAGTGACCAGCATTAAAAAGAGAGGAGAAAGTCTAGGATACACAGAAGGGGCCTTGTTGGCTC

TGGCCTTCATCATCATCCTCTGCTGCATTCCTGCCATCTTGGTGGTTTTGGTCAGCTACAGACA

GTTTAAAGTACGTCAAGCTGAGTGTACAAAGACTGCACGAATTCAGGCCGCATTACCCGCGGCT

AAACCAGCAGTGCCGGCTCCTGCACCAGTGGCAGCGCCCCCGCCGCCGCCGCCGCCTCCGCCAG

GTGCGCATCTCTATGAAGAACTTGGAGACAGCTCAATGCATAAGTATGAAATGCCTCAATATGG

GAGTCGCCGTCGATTGTTACCACCAGCTGGACAGGAGGAATATGGTGAGGTGGTTGGTGAAGCT

GAGGAAGAATATGAGGAGGAAGAGTGGGCAAGAAAAAGAATGATCAAGTTAGTTGTTGATCGAG

AGTATGAAACCAGCTCAACTGGAGAAGACAGTGCTCCTGAATGTCAGAGAAACCGTCTTCACCA

-continued

```
TCCTAGTATCCACAGTAATATCAACGGCAATATATATATTGCACAGAATGGTTCTGTGGTGAGA

ACCCGCCGTGCCTGCCTCACGGACAACTTAAAAGTTGCTTCCCCTGTTCGACTGGGAGGGCCCT

TTAAGAAACTAGACAAGTTGGCAGTGACACATGAGGAGAATGTACCTCTGAACACATTATCAAA

GGGGCCATTTTCTACTGAAAAAATGAATGCAAGACCAACTCTGGTTACATTTGCCCCTTGCCCT

GTGGGGACTGACAATACAGCGGTGAAGCCACTAAGGAACAGGCTGAAAAGCACAGTTGAACAGG

AGTCCATGATTGACAGTAAGAACATCAAGGAGGCTTTGGAATTTCATAGTGACCACACACAGTC

TGATGATGAAGAGCTTTGGATGGGCCCCTGGAACAACCTCCATATACCAATGACAAAACTGTGA
```

In some examples, the mini-PCDH15 lacks EC4, EC5, EC6, EC9 and EC10 domain. In some embodiments, the mini-PCDH15 includes EC1-EC2-EC3-EC7-EC8-EC11 of SEQ ID NO: 1, 53, 55, or 57. In one example, the mini-PCDH15 comprises an amino acid sequence at least 60%, 70%, 75%, 80%, 85%, 90%, 91%, 92%, 93%, 94%, 95%, 96%, 97%, 98%, 99% or 100% identical to SEQ ID NO: 43, 99 or 100. In some embodiments, the nucleic acid encoding the mini-PCDH15 lacking EC4, EC5, EC6, EC9 and EC10 is at least 60%, 70%, 75%, 80%, 85%, 90%, 91%, 92%, 93%, 94%, 95%, 96%, 97%, 98%, 99% or 100% identical to SEQ ID NO: 44, 101 or 102.

An exemplary amino acid sequence of a mini-PCDH15 lacking EC4, EC5, EC6, EC9 and EC10 (V7) is set forth in SEQ ID NO: 43 (mini-PCDH15 V7: includes EC1-EC2-EC3-EC7-EC8-EC11-MAD12-TM-cyto CD1; different domains alternating in bold and regular font):

(SEQ ID NO: 43)

MFRQFYLWTCLASGTTLGSLFEICLGQYDDDWQYEDCKLARGGPPATTVAIDEESRNGTTLVDN

MLIKGTAGGPDPTTELSLKDNVDYWVLMDPVKQMLFLNSTGRVLDRDPPMNIHSIVVQVQCTNK

KVGTTIYHEVRIVVRDRNDNSPTFKHESYYATVNELTPVGTTTFTGFSGDNGATDIDDGPNGQI

EYVIQYNPDDPTSNDTFEIPLMLTGNIVLRKRLNYEDKTRYFVIIQANDRAQNLNERRTTTTTL

TVDVLDGDDLGPMFLPCVINPNTRDCRPLTYQAAIPELRTPEELNPIIVTPPIQAIDQDRNIQP

PSDRPGTLYSILVGTPEDYPRFFHMHPRTAELSLLEPVNRDFHQKFDLVIKAEQDNGHPLPAFA

GLHIEILDENNQAPVFDPYLPRNLSVVEEEANAFVGQVKATDPDAGTNGQVHYSLGNFNNLFRI

TSNGSIYTAVKLNREVRDYYELVVVATDGAVHPRHSTLTLAIKVLDIDDNSPVFTNSTYTVLVE

ENLPAGTTTLQIEAKDVDLGANVSYRIRSPEVKHFFALHPFTGELSLLRSLDYEAFPDQEASIT

FLVEAFDIYGTMPPGTATVTVIVKDMNDYPPVFQKKFYIGGVSEDARMFTSVLRVKATDKDTGN

YSVMAYRLIIPPIKEGKEGFVVETYTGLIKTAMLFHNMRRSYFKFQVIATDDYGKGLSGKADVL

VSVVNQLDMQVIVSNVPPTLVEKKIEDLTEILDRYVQEQIPGAKVVVESIGARRHGDAFSLEDY

TKCDLTVYAIDPQTNRAIDRNELFKFLDGKLLDINKDFQPYYGEGGRILEIRTPEAVTSIKKRG

ESLGYTEGALLALAFIIILCCTPAILVVLVSYRQFKVRQAECTKTARIQAALPAAKPAVPAPAP

VAAPPPPPPPPPGAHLYEELGDSSMHNLFLLYHFQQSRGNNSVSEDRKHQQVVMPFSSNTTEAH

KSAHVDGSLKSNKLKSARKFTFLSDEDDLSAHNPLYKENISQVSTNSDISQRTDFVDPFSPKIQ

AKSKSLRGPREKIQRLWSQSVSLPRRLMRKVPNRPEIIDLQQWQGTRQKAENENTGTCTNKRGS

SNPLLTTEEANLTEKEEIRQGETLMIEGTEQLKSLSSDSSFCFPRPHFSFSTLPTVSRTVELKS

EPNVISSPAECSLELSPSRPCVLHSSLSRRETPICMLPIETERNIFENFAHPPNISPSACPLPP

PPPISPPSPPPAPAPLAPPPDISPFSLFCPPPSPPSIPLPLPPPTFFPLSVSTSGPPTPPLLPP

FPTPLPPPPPSIPCPPPPSASFLSTECVCTTGVKCTTNLMPAEKIKSSMTQLSTTTVCKTDPQR

EPKGTLRHVKNLAELEKSVANMYSQIEKNYLRTNVSELQTMCPSEVTNMEITSEQNKGSLNNIV

EGTEKQSHSQSTSL

An exemplary amino acid sequence of a mini-PCDH15 lacking EC4, EC5, EC6, EC9 and EC10 (V7) is set forth in SEQ ID NO: 99 (mini-PCDH15 V7: includes EC1-EC2-EC3-EC7-EC8-EC11-MAD12-TM-cyto CD2; different domains alternating in bold and regular font):

```
                                                          (SEQ ID NO: 99)
MFRQFYLWTCLASGTTLGSLFEICLGQYDDDWQYEDCKLARGGPPATTVAIDEESRNGTTLVDN

MLIKGTAGGPDPTTELSLKDNVDYWVLMDPVKQMLFLNSTGRVLDRDPPMNIHSIVVQVQCTNK

KVGTTIYHEVRIVVRDRNDNSPTFKHESYYATVNELTPVGTTTFTGFSGDNGATDIDDGPNGQI

EYVIQYNPDDPTSNDTFEIPLMLTGNIVLRKRLNYEDKTRYFVIIQANDRAQNLNERRTTTTTL

TVDVLDGDDLGPMFLPCVLVPNTRDCRPLTYQAAIPELRTPEELNPIIVTPPIQAIDQDRNIQP

PSDRPGTLYSILVGTPEDYPRFFHMHPRTAELSLLEPVNRDFHQKFDLVIKAEQDNGHPLPAFA

GLHIEILDENNQAPVFDPYLPRNLSVVEEEANAFVGQVKATDPDAGTNGQVHYSLGNFNNLFRI

TSNGSIYTAVKLNREVRDYYELVVVATDGAVHPRHSTLTLAIKVLDIDDNSPVFTNSTYTVLVE

ENLPAGTTTLQIEAKDVDLGANVSYRIRSPEVKHFFALHPFTGELSLLRSLDYEAFPDQEASIT

FLVEAFDIYGTMPPGTATVTVIVKDMNDYPPVFQKKFYIGGVSEDARMFTSVLRVKATDKDTGN

YSVMAYRLIIPPIKEGKEGFVVETYTGLIKTAMLFHNMRRSYFKFQVIATDDYGKGLSGKADVL

VSVVNQLDMQVIVSNVPPTLVEKKIEDLTEILDRYVQEQIPGAKVVVESIGARRHGDAFSLEDY

TKCDLTVYAIDPQTNRAIDRNELFKFLDGKLLDINKDFQPYYGEGGRILEIRTPEAVTSIKKRG

ESLGYTEGALLALAFIIILCCTPAILVVLVSYRQFKVRQAECTKTARIQAALPAAKPAVPAPAP

VAAPPPPPPPPPGAHLYEELGDSSMHKYEMPQYGSRRRLLPPAGQEEYGEVVGEAEEEYEEEEE

EPKKIKKPKVEIREPSEEEEVVVTTEKPPAAEPTYTTWKRARIFPMIFKKVRGLADKRGTVDLE

GEEWQRRLEEEDKDYLKLTLDQEEATESTVESEEESSSDYTEYSEEESEFSESETTEEESESET

PSEEEESSTPESEESESTESEGEKARKNIVLARRRPMVEEVKEVKGRKEEPQEEQKEPKMEEEE

HSEEEESGPAPVEESTDPEAQDIPEEGSAESASVEGGVESEEESESGSSSSSSESQSGGPWGYQ

VPAYDRSKNANQKKSPGANSEGYNTAL
```

An exemplary amino acid sequence of a mini-PCDH15 lacking EC4, EC5, EC6, EC9 and EC10 (V7) is set forth in SEQ ID NO: 100 (mini-PCDH15 V7: includes EC1-EC2-EC3-EC7-EC8-EC11-MAD12-TM-cyto CD3; different domains alternating in bold and regular font):

```
                                                         (SEQ ID NO: 100)
MFRQFYLWTCLASGTTLGSLFEICLGQYDDDWQYEDCKLARGGPPATTVAIDEESRNGTTLVDN

MLIKGTAGGPDPTTELSLKDNVDYWVLMDPVKQMLFLNSTGRVLDRDPPMNIHSIVVQVQCTNK

KVGTTIYHEVRIVVRDRNDNSPTFKHESYYATVNELTPVGTTTFTGFSGDNGATDIDDGPNGQI

EYVIQYNPDDPTSNDTFEIPLMLTGNIVLRKRLNYEDKTRYFVIIQANDRAQNLNERRTTTTTL

TVDVLDGDDLGPMFLPCVLVPNTRDCRPLTYQAAIPELRTPEELNPIIVTPPIQAIDQDRNIQP

PSDRPGTLYSILVGTPEDYPRFFHMHPRTAELSLLEPVNRDFHQKFDLVIKAEQDNGHPLPAFA

GLHIEILDENNQAPVFDPYLPRNLSVVEEEANAFVGQVKATDPDAGTNGQVHYSLGNFNNLFRI

TSNGSIYTAVKLNREVRDYYELVVVATDGAVHPRHSTLTLAIKVLDIDDNSPVFTNSTYTVLVE

ENLPAGTTTLQIEAKDVDLGANVSYRIRSPEVKHFFALHPFTGELSLLRSLDYEAFPDQEASIT

FLVEAFDIYGTMPPGTATVTVIVKDMNDYPPVFQKKFYIGGVSEDARMFTSVLRVKATDKDTGN

YSVMAYRLIIPPIKEGKEGFVVETYTGLIKTAMLFHNMRRSYFKFQVIATDDYGKGLSGKADVL

VSVVNQLDMQVIVSNVPPTLVEKKIEDLTEILDRYVQEQIPGAKVVVESIGARRHGDAFSLEDY
```

40

-continued

TKCDLTVYAIDPQTNRAIDRNELFKFLDGKLLDINKDFQPYYGEGGRILEIRTPEAVTSIKKRG

ESLGYTEGALLALAFIIILCCTPAILVVLVSYRQFKVRQAECTKTARIQAALPAAKPAVPAPAP

VAAPPPPPPPPPGAHLYEELGDSSMHKYEMPQYGSRRRLLPPAGQEEYGEVVGEAEEEYEEEEW

ARKRMIKLVVDREYETSSTGEDSAPECQRNRLHHPSIHSNINGNIYIAQNGSVVRTRRACLTDN

LKVASPVRLGGPFKKLDKLAVTHEENVPLNTLSKGPFSTEKMNARPTLVTFAPCPVGTDNTAVK

PLRNRLKSTVEQESMIDSKNIKEALEFHSDHTQSDDEELWMGPWNNLHIPMTKL

An exemplary nucleic acid sequence encoding a mini-PCDH15 lacking EC4, EC5, EC6, EC9 and EC10 (V7) is set forth in SEQ ID NO: 44 (mini-PCDH15 V7: includes EC1-EC2-EC3-EC7-EC8-EC11-MAD12-TM-cyto CD1):

(SEQ ID NO: 44)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAGCTCCAGTGTTTGATCCTTATCTGCCAA

GAAATTTATCTGTGGTGGAAGAAGAAGCCAATGCCTTTGTGGGTCAAGTAAAAGCAACAGACCC

TGATGCTGGAATAAATGGTCAAGTGCACTACAGTTTGGGTAACTTTAATAATCTTTTTCGTATC

ACATCCAATGGGAGCATTTACACAGCAGTGAAGCTTAACAGAGAAGTCAGGGACTACTATGAAC

TTGTTGTTGTGGCAACAGATGGAGCAGTACACCCTCGTCATTCAACTCTAACCTTGGCCATCAA

GGTTTTGGACATTGATGATAACAGTCCTGTGTTCACCAATTCAACATACACTGTCCTTGTTGAA

GAGAATTTGCCAGCTGGGACTACCATCCTTCAAATAGAGGCCAAAGATGTCGACCTTGGAGCAA

ATGTGTCTTACCGGATAAGAAGCCCAGAAGTGAAGCACTTTTTTGCACTACATCCATTTACAGG

AGAACTATCGCTTTTAAGGAGTTTAGATTATGAGGCATTTCCAGACCAAGAAGCAAGTATCACT

TTTCTGGTAGAGGCCTTTGATATTTATGGAACAATGCCACCTGGTATTGCTACTGTCACAGTGA

TTGTAAAGGATATGAATGATTATCCCCCAGTGTTTCAGAAAAAATTCTACATCGGAGGTGTATC

TGAAGATGCAAGAATGTTTACTTCTGTACTCAGAGTGAAGGCTACTGATAAAGATACTGGCAAT

TATAGTGTCATGGCCTACAGACTCATAATACCACCAATTAAAGAGGGAAAAGAAGGATTTGTAG

```
TGGAAACATATACAGGGCTTATCAAAACTGCTATGCTCTTCCATAATATGAGGAGATCCTACTT

CAAGTTTCAAGTTATTGCAACTGACGACTATGGGAAGGGACTGAGCGGCAAAGCCGATGTACTC

GTCTCCGTGGTCAATCAGCTGGATATGCAAGTCATTGTTTCCAATGTGCCTCCTACTCTAGTGG

AAAAAAAGATAGAAGATCTTACAGAGATCTTGGATCGCTATGTTCAGGAACAAATTCCTGGTGC

CAAGGTCGTAGTGGAGTCCATTGGAGCTCGCCGGCATGGAGATGCCTTTTCCCTAGAAGATTAC

ACCAAATGTGACTTGACTGTCTATGCAATTGACCCCCAAACCAACAGAGCCATCGATAGAAATG

AGCTTTTTAAATTTTTGGATGGCAAACTACTTGATATCAATAAAGACTTTCAGCCGTATTATGG

GGAAGGAGGACGCATTCTGGAGATCCGGACTCCAGAGGCAGTGACCAGCATTAAAAAGAGAGGA

GAAAGTCTAGGATACACAGAAGGGGCCTTGTTGGCTCTGGCCTTCATCATCATCCTCTGCTGCA

TTCCTGCCATCTTGGTGGTTTTGGTCAGCTACAGACAGTTTAAAGTACGTCAAGCTGAGTGTAC

AAAGACTGCACGAATTCAGGCCGCATTACCCGCGGCTAAACCAGCAGTGCCGGCTCCTGCACCA

GTGGCAGCGCCCCCGCCGCCGCCGCCGCCTCCGCCAGGTGCGCATCTCTATGAAGAACTTGGAG

ACAGCTCAATGCATAATCTTTTCCTTCTCTACCATTTTCAACAAAGCAGGGGAAATAACTCAGT

CTCAGAAGACAGGAAACATCAACAAGTTGTGATGCCCTTTTCTTCCAATACTATTGAGGCTCAC

AAGTCAGCTCATGTAGACGGATCACTTAAGAGCAACAAACTGAAGTCTGCAAGAAAATTCACAT

TTCTATCTGATGAGGATGACTTAAGTGCCCATAATCCCCTTTATAAGGAAAACATAAGTCAAGT

ATCAACAAATTCAGACATTTCACAGAGAACAGATTTTGTAGACCCATTTTCACCCAAAATACAA

GCCAAGAGTAAGTCTCTGAGGGGCCCAAGAGAAAAGATTCAGAGGCTGTGGAGTCAGTCAGTCA

GCTTACCCAGGAGGCTGATGAGGAAAGTTCCAAATAGACCAGAGATCATAGATCTGCAGCAGTG

GCAAGGCACCAGGCAGAAAGCTGAAAATGAAAACACTGGAATCTGTACAAACAAAAGAGGTAGC

AGCAATCCATTGCTTACAACTGAAGAGGCAAATTTGACAGAGAAAGAGGAAATAAGGCAAGGTG

AAACACTGATGATAGAAGGAACAGAACAGTTGAAATCTCTCTCTTCAGACTCTTCATTTTGCTT

TCCCAGGCCTCACTTCTCATTCTCCACTTTGCCAACTGTTTCAAGAACTGTGGAACTCAAATCA

GAACCTAATGTCATCAGTTCTCCTGCTGAGTGTTCCTTGGAACTTTCTCCTTCAAGGCCTTGTG

TTTTACATTCTTCACTCTCTAGGAGAGAGACACCTATTTGTATGTTACCTATTGAAACCGAAAG

AAATATTTTTGAAAATTTTGCCCATCCACCAAACATCTCTCCTTCTGCCTGTCCCCTTCCCCCT

CCTCCTCCTATTTCTCCTCCTTCTCCTCCTCCTGCTCCTGCTCCTCTTGCTCCTCCTCCTGACA

TTTCTCCTTTTTCTCTTTTTTGTCCTCCTCCCTCTCCTCCTTCTATCCCTCTTCCTCTTCCTCC

ICCTACATTTTTTCCACTTTCCGTTTCAACGTCTGGTCCCCCAACACCACCTCTTCTACCTCCA

ITTCCAACTCCTCTTCCTCCACCACCTCCTTCTATTCCTTGCCCTCCACCTCCTTCAGCTTCAT

TTCTGTCCACAGAGTGTGTCTGTATAACAGGTGTTAAATGCACGACCAACTTGATGCCTGCCGA

GAAAATTAAGTCCTCTATGACACAGCTATCAACAACGACAGTGTGTAAAACAGACCCTCAGAGA

GAACCAAAAGGCATCCTCAGACACGTTAAAAACTTAGCAGAACTTGAAAAATCAGTAGCTAACA

TGTACAGTCAAATAGAAAAAAAACTATCTACGCACAAATGTTTCAGAACTTCAAACTATGTGCCC
```

-continued

```
TTCAGAAGTAACAAATATGGAAATCACATCTGAACAAAACAAGGGGAGTTTGAACAATATTGTC

GAGGGAACTGAAAAACAATCTCACAGTCAATCTACTTCACTGTAA
```

An exemplary nucleic acid sequence encoding a mini-PCDH15 lacking EC4, EC5, EC6, EC9 and EC10 (V7) is set forth in SEQ ID NO: 101 (mini-PCDH15 V7: includes EC1-EC2-EC3-EC7-EC8-EC11-MAD12-TM-cyto CD2):

```
                                             (SEQ ID NO: 101)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAGCTCCAGTGTTTGATCCTTATCTGCCAA

GAAATTTATCTGTGGTGGAAGAAGAAGCCAATGCCTTTGTGGGTCAAGTAAAAGCAACAGACCC

TGATGCTGGAATAAATGGTCAAGTGCACTACAGTTTGGGTAACTTTAATAATCTTTTTCGTATC

ACATCCAATGGGAGCATTTACACAGCAGTGAAGCTTAACAGAGAAGTCAGGGACTACTATGAAC

TTGTTGTTGTGGCAACAGATGGAGCAGTACACCCTCGTCATTCAACTCTAACCTTGGCCATCAA

GGTTTTGGACATTGATGATAACAGTCCTGTGTTCACCAATTCAACATACACTGTCCTTGTTGAA

GAGAATTTGCCAGCTGGGACTACCATCCTTCAAATAGAGGCCAAAGATGTCGACCTTGGAGCAA

ATGTGTCTTACCGGATAAGAAGCCCAGAAGTGAAGCACTTTTTTGCACTACATCCATTTACAGG

AGAACTATCGCTTTTAAGGAGTTTAGATTATGAGGCATTTCCAGACCAAGAAGCAAGTATCACT

TTTCTGGTAGAGGCCTTTGATATTTATGGAACAATGCCACCTGGTATTGCTACTGTCACAGTGA

TTGTAAAGGATATGAATGATTATCCCCCAGTGTTTCAGAAAAAATTCTACATCGGAGGTGTATC

TGAAGATGCAAGAATGTTTACTTCTGTACTCAGAGTGAAGGCTACTGATAAAGATACTGGCAAT

TATAGTGTCATGGCCTACAGACTCATAATACCACCAATTAAAGAGGGAAAAGAAGGATTTGTAG

TGGAAACATATACAGGGCTTATCAAAACTGCTATGCTCTTCCATAATATGAGGAGATCCTACTT

CAAGTTTCAAGTTATTGCAACTGACGACTATGGGAAGGGACTGAGCGGCAAAGCCGATGTACTC

GTCTCCGTGGTCAATCAGCTGGATATGCAAGTCATTGTTTCCAATGTGCCTCCTACTCTAGTGG

AAAAAAAGATAGAAGATCTTACAGAGATCTTGGATCGCTATGTTCAGGAACAAATTCCTGGTGC
```

-continued

```
CAAGGTCGTAGTGGAGTCCATTGGAGCTCGCCGGCATGGAGATGCCTTTTCCCTAGAAGATTAC

ACCAAATGTGACTTGACTGTCTATGCAATTGACCCCCAAACCAACAGAGCCATCGATAGAAATG

AGCTTTTTAAATTTTTGGATGGCAAACTACTTGATATCAATAAAGACTTTCAGCCGTATTATGG

GGAAGGAGGACGCATTCTGGAGATCCGGACTCCAGAGGCAGTGACCAGCATTAAAAAGAGAGGA

GAAAGTCTAGGATACACAGAAGGGGCCTTGTTGGCTCTGGCCTTCATCATCATCCTCTGCTGCA

TTCCTGCCATCTTGGTGGTTTTGGTCAGCTACAGACAGTTTAAAGTACGTCAAGCTGAGTGTAC

AAAGACTGCACGAATTCAGGCCGCATTACCCGCGGCTAAACCAGCAGTGCCGGCTCCTGCACCA

GTGGCAGCGCCCCCGCCGCCGCCGCCGCCTCCGCCAGGTGCGCATCTCTATGAAGAACTTGGAG

ACAGCTCAATGCATAAGTATGAAATGCCTCAATATGGGAGTCGCCGTCGATTGTTACCACCAGC

TGGACAGGAGGAATATGGTGAGGTGGTTGGTGAAGCTGAGGAAGAATATGAGGAGGAAGAGGAA

GAGCCAAAGAAAATTAAAAAACCAAAGGTTGAAATTAGAGAGCCTAGTGAGGAGGAAGAAGTAG

TTGTAACTATCGAAAAACCACCAGCAGCTGAGCCTACATACACAACATGGAAGAGAGCCAGAAT

ATTCCCCATGATTTTTAAGAAAGTTAGAGGATTAGCTGATAAAAGAGGAATCGTTGACCTTGAG

GGTGAAGAGTGGCAGAGACGCCTTGAGGAAGAAGATAAAGATTATTTGAAACTCACTCTGGACC

AAGAGGAAGCAACAGAAAGCACTGTAGAATCAGAGGAGGAATCCTCCAGCGACTATACTGAATA

CAGTGAAGAAGAGTCTGAGTTCAGTGAGTCTGAGACTACAGAAGAGGAATCTGAGTCAGAGACA

CCCTCTGAGGAGGAGGAGAGTTCCACCCCTGAATCAGAAGAATCGGAATCCACAGAGTCAGAAG

GAGAAAAAGCAAGGAAAAACATTGTGCTTGCAAGAAGAAGGCCCATGGTTGAGGAGGTCAAGGA

AGTCAAGGGTAGGAAAGAGGAGCCACAAGAAGAACAAAAAGAACCTAAGATGGAAGAAGAAGAA

CACTCAGAAGAAGAAGAAAGTGGACCAGCCCCTGTGGAAGAAAGTACAGACCCTGAAGCTCAAG

ATATCCCTGAAGAGGGCAGTGCAGAATCAGCTTCGGTGGAAGGAGGTGTGGAAAGTGAGGAGGA

ATCAGAATCAGGTAGTAGTAGCAGTAGTAGCGAAAGTCAGTCTGGAGGTCCATGGGGCTATCAG

GTACCAGCGTATGACAGAAGCAAGAATGCAAACCAAAAGAAGTCGCCAGGAGCAAACTCTGAAG

GTTACAACACAGCACTTTGA
```

40

An exemplary nucleic acid sequence encoding a mini-PCDH15 lacking EC4, EC5, EC6, EC9 and EC10 (V7) is set forth in SEQ ID NO: 102 (mini-PCDH15 V7: includes EC1-EC2-EC3-EC7-EC8-EC11-MAD12-TM-cyto CD3):

(SEQ ID NO: 102)
```
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA
```

-continued

```
ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAGCTCCAGTGTTTGATCCTTATCTGCCAA

GAAATTTATCTGTGGTGGAAGAAGAAGCCAATGCCTTTGTGGGTCAAGTAAAAGCAACAGACCC

TGATGCTGGAATAAATGGTCAAGTGCACTACAGTTTGGGTAACTTTAATAATCTTTTTCGTATC

ACATCCAATGGGAGCATTTACACAGCAGTGAAGCTTAACAGAGAAGTCAGGGACTACTATGAAC

TTGTTGTTGTGGCAACAGATGGAGCAGTACACCCTCGTCATTCAACTCTAACCTTGGCCATCAA

GGTTTTGGACATTGATGATAACAGTCCTGTGTTCACCAATTCAACATACACTGTCCTTGTTGAA

GAGAATTTGCCAGCTGGGACTACCATCCTTCAAATAGAGGCCAAAGATGTCGACCTTGGAGCAA

ATGTGTCTTACCGGATAAGAAGCCCAGAAGTGAAGCACTTTTTTGCACTACATCCATTTACAGG

AGAACTATCGCTTTTAAGGAGTTTAGATTATGAGGCATTTCCAGACCAAGAAGCAAGTATCACT

TTTCTGGTAGAGGCCTTTGATATTTATGGAACAATGCCACCTGGTATTGCTACTGTCACAGTGA

TTGTAAAGGATATGAATGATTATCCCCCAGTGTTTCAGAAAAAATTCTACATCGGAGGTGTATC

TGAAGATGCAAGAATGTTTACTTCTGTACTCAGAGTGAAGGCTACTGATAAAGATACTGGCAAT

TATAGTGTCATGGCCTACAGACTCATAATACCACCAATTAAAGAGGGAAAAGAAGGATTTGTAG

TGGAAACATATACAGGGCTTATCAAAACTGCTATGCTCTTCCATAATATGAGGAGATCCTACTT

CAAGTTTCAAGTTATTGCAACTGACGACTATGGGAAGGGACTGAGCGGCAAAGCCGATGTACTC

GTCTCCGTGGTCAATCAGCTGGATATGCAAGTCATTGTTTCCAATGTGCCTCCTACTCTAGTGG

AAAAAAAGATAGAAGATCTTACAGAGATCTTGGATCGCTATGTTCAGGAACAAATTCCTGGTGC

CAAGGTCGTAGTGGAGTCCATTGGAGCTCGCCGGCATGGAGATGCCTTTTCCCTAGAAGATTAC

ACCAAATGTGACTTGACTGTCTATGCAATTGACCCCCAAACCAACAGAGCCATCGATAGAAATG

AGCTTTTTAAATTTTTGGATGGCAAACTACTTGATATCAATAAAGACTTTCAGCCGTATTATGG

GGAAGGAGGACGCATTCTGGAGATCCGGACTCCAGAGGCAGTGACCAGCATTAAAAAGAGAGGA

GAAAGTCTAGGATACACAGAAGGGGCCTTGTTGGCTCTGGCCTTCATCATCATCCTCTGCTGCA

TTCCTGCCATCTTGGTGGTTTTGGTCAGCTACAGACAGTTTAAAGTACGTCAAGCTGAGTGTAC

AAAGACTGCACGAATTCAGGCCGCATTACCCGCGGCTAAACCAGCAGTGCCGGCTCCTGCACCA

GTGGCAGCGCCCCCGCCGCCGCCGCCGCCTCCGCCAGGTGCGCATCTCTATGAAGAACTTGGAG

ACAGCTCAATGCATAAGTATGAAATGCCTCAATATGGGAGTCGCCGTCGATTGTTACCACCAGC

TGGACAGGAGGAATATGGTGAGGTGGTTGGTGAAGCTGAGGAAGAATATGAGGAGGAAGAGTGG

GCAAGAAAAGAATGATCAAGTTAGTTGTTGATCGAGAGTATGAAACCAGCTCAACTGGAGAAG

ACAGTGCTCCTGAATGTCAGAGAAACCGTCTTCACCATCCTAGTATCCACAGTAATATCAACGG

CAATATATATATTGCACAGAATGGTTCTGTGGTGAGAACCCGCCGTGCCTGCCTCACGGACAAC

TTAAAAGTTGCTTCCCCTGTTCGACTGGGAGGGCCCTTTAAGAAACTAGACAAGTTGGCAGTGA

CACATGAGGAGAATGTACCTCTGAACACATTATCAAAGGGGCCATTTTCTACTGAAAAAATGAA

TGCAAGACCAACTCTGGTTACATTTGCCCCTTGCCCTGTGGGGACTGACAATACAGCGGTGAAG

CCACTAAGGAACAGGCTGAAAAGCACAGTTGAACAGGAGTCCATGATTGACAGTAAGAACATCA

AGGAGGCTTTGGAATTTCATAGTGACCACACACAGTCTGATGATGAAGAGCTTTGGATGGGCCC

CTGGAACAACCTCCATATACCAATGACAAAACTGTGA
```

In some examples, the mini-PCDH15 lacks EC5, EC6, EC8, EC9 and EC10 domain. In some embodiments, the mini-PCDH15 includes EC1-EC2-EC3-EC4-EC7-EC11 of SEQ ID NO: 1, 53, 55, or 57. In one example, the mini-PCDH15 comprises an amino acid sequence at least 60%, 70%, 75%, 80%, 85%, 90%, 91%, 92%, 93%, 94%, 95%, 96%, 97%, 98%, 99% or 100% identical to SEQ ID NO: 45, 103, or 104. In some embodiments, the nucleic acid encoding the mini-PCDH15 lacking EC5, EC6, EC8, EC9 and EC10 is at least 60%, 70%, 75%, 80%, 85%, 90%, 91%, 92%, 93%, 94%, 95%, 96%, 97%, 98%, 99% or 100% identical to SEQ ID NO: 46, 105, or 106.

An exemplary amino acid sequence of a mini-PCDH15 lacking EC5, EC6, EC8, EC9 and EC10 (V8) is set forth in SEQ ID NO: 45 (mini-PCDH15 V8: includes EC1-EC2-EC3-EC4-EC7-EC11-MAD12-TM-cyto CD1; different domains alternating in bold and regular font):

(SEQ ID NO: 45)

MFRQFYLWTCLASGTTLGSLFEICLGQYDDDWQYEDCKLARGGPPATTVAIDEESRNGTTLVDN

MLIKGTAGGPDPTTELSLKDNVDYWVLMDPVKQMLFLNSTGRVLDRDPPMNIHSIVVQVQCTNK

KVGTTIYHEVRIVVRDRNDNSPTFKHESYYATVNELTPVGTTTFTGFSGDNGATDIDDGPNGQI

EYVIQYNPDDPTSNDTFEIPLMLTGNIVLRKRLNYEDKTRYFVIIQANDRAQNLNERRTTTTTL

TVDVLDGDDLGPMFLPCVINPNTRDCRPLTYQAAIPELRTPEELNPIIVTPPIQAIDQDRNIQP

PSDRPGTLYSILVGTPEDYPRFFHMHPRTAELSLLEPVNRDFHQKFDLVIKAEQDNGHPLPAFA

GLHIEILDENNQSPYFTMPSYQGYILESAPVGATTSDSLNLTSPLRIVALDKDIEDTKDPELHL

FLNDYTSVFTVTQTGTTRYLTLLQPVDREEQQTYTFSITAFDGVQESEPVIVNIQVMDANDNAP

VFDPYLPRNLSVVEEEANAFVGQVKATDPDAGTNGQVHYSLGNFNNLFRITSNGSIYTAVKLNR

EVRDYYELVVVATDGAVHPRHSTLTLAIKVLDIDDNPPVFQKKFYIGGVSEDARMFTSVLRVKA

TDKDTGNYSVMAYRLIIPPIKEGKEGFVVETYTGLIKTAMLFHNMRRSYFKFQVIATDDYGKGL

SGKADVLVSVVNQLDMQVIVSNVPPTLVEKKIEDLTEILDRYVQEQIPGAKVVVESIGARRHGD

AFSLEDYTKCDLTVYAIDPQTNRAIDRNELFKFLDGKLLDINKDFQPYYGEGGRILEIRTPEAV

ISIKKRGESLGYTEGALLALAFIIILCCTPAILVVLVSYRQFKVRQAECTKTARIQAALPAAKP

AVPAPAPVAAPPPPPPPPPGAHLYEELGDSSMHNLFLLYHFQQSRGNNSVSEDRKHQQVVMPFS

SNTTEAHKSAHVDGSLKSNKLKSARKFTFLSDEDDLSAHNPLYKENISQVSTNSDISQRTDFVD

PFSPKIQAKSKSLRGPREKIQRLWSQSVSLPRRLMRKVPNRPEIIDLQQWQGTRQKAENENTGT

CTNKRGSSNPLLTTEEANLTEKEEIRQGETLMIEGTEQLKSLSSDSSFCFPRPHFSFSTLPTVS

RTVELKSEPNVISSPAECSLELSPSRPCVLHSSLSRRETPICMLPIETERNIFENFAHPPNISP

SACPLPPPPPISPPSPPPAPAPLAPPPDISPFSLFCPPPSPPSIPLPLPPPTFFPLSVSTSGPP

TPPLLPPFPTPLPPPPPSIPCPPPPSASFLSTECVCTTGVKCTTNLMPAEKIKSSMTQLSTTTV

CKTDPQREPKGTLRHVKNLAELEKSVANMYSQIEKNYLRTNVSELQTMCPSEVTNMEITSEQNK

GSLNNIVEGTEKQSHSQSTSL

An exemplary amino acid sequence of a mini-PCDH15 lacking EC5, EC6, EC8, EC9 and EC10 (V8) is set forth in SEQ ID NO: 103 (mini-PCDH15 V8: includes EC1-EC2-EC3-EC4-EC7-EC11-MAD12-TM-cyto CD2; different domains alternating in bold and regular font):

(SEQ ID NO: 103)

MFRQFYLWTCLASGTTLGSLFEICLGQYDDDWQYEDCKLARGGPPATTVAIDEESRNGTTLVDN

MLIKGTAGGPDPTTELSLKDNVDYWVLMDPVKQMLFLNSTGRVLDRDPPMNIHSIVVQVQCTNK

KVGTTIYHEVRIVVRDRNDNSPTFKHESYYATVNELTPVGTTTFTGFSGDNGATDIDDGPNGQI

EYVIQYNPDDPTSNDTFEIPLMLTGNIVLRKRLNYEDKTRYFVIIQANDRAQNLNERRTTTTTL

TVDVLDGDDLGPMFLPCVLVPNTRDCRPLTYQAAIPELRTPEELNPIIVTPPIQAIDQDRNIQP

PSDRPGTLYSILVGTPEDYPRFFHMHPRTAELSLLEPVNRDFHQKFDLVIKAEQDNGHPLPAFA

-continued

GLHIEILDENNQSPYFTMPSYQGYILESAPVGATTSDSLNLTSPLRIVALDKDIEDTKDPELHL

FLNDYTSVFTVTQTGTTRYLTLLQPVDREEQQTYTFSITAFDGVQESEPVIVNIQVMD<u>ANDN</u>AP

VFDPYLPRNLSVVEEEANAFVGQVKATDPDAGTNGQVHYSLGNFNNLFRITSNGSIYTAVKLNR

EVRDYYELVVVATDGAVHPRHSTLTLAIKVLD<u>IDDN</u>PPVFQKKFYIGGVSEDARMFTSVLRVKA

TDKDTGNYSVMAYRLIIPPIKEGKEGFVVETYTGLIKTAMLFHNMRRSYFKFQVIATDDYGKGL

SGKADVLVSVVNQLDMQVIVSNVPPTLVEKKIEDLTEILDRYVQEQIPGAKVVVESIGARRHGD

AFSLEDYTKCDLTVYAIDPQTNRAIDRNELFKFLDGKLLDINKDFQPYYGEGGRILEIRTPEAV

ISIKKRGESLGYTEGALLALAFIIILCCTPAILVVLVSYRQFKVRQAECTKTARIQAALPAAKP

AVPAPAPVAAPPPPPPPPPPGAHLYEELGDSSMHKYEMPQYGSRRRLLPPAGQEEYGEVVGEAEE

EYEEEEEPKKIKKPKVEIREPSEEEEVVVTTEKPPAAEPTYTTWKRARIFPMIFKKVRGLADK

RGTVDLEGEEWQRRLEEEDKDYLKLTLDQEEATESTVESEEESSSDYTEYSEEESEFSESETTE

EESESETPSEEEESSTPESEESESTESEGEKARKNIVLARRRPMVEEVKEVKGRKEEPQEEQKE

PKMEEEEHSEEEEESGPAPVEESTDPEAQDIPEEGSAESASVEGGVESEEEESESGSSSSSSESQS

GGPWGYQVPAYDRSKNANQKKSPGANSEGYNTAL

An exemplary amino acid sequence of a mini-PCDH15 lacking EC5, EC6, EC8, EC9 and EC10 (V8) is set forth in SEQ ID NO: 104 (mini-PCDH15 V8: includes EC1-EC2-EC3-EC4-EC7-EC11-MAD12-TM-cyto CD3; different domains alternating in bold and regular font):

(SEQ ID NO: 104)

MFRQFYLWTCLASGTTLGSLFEICLGQYDDDWQYEDCKLARGGPPATTVAIDEESRNGTTLVDN

MLIKGTAGGPDPTTELSLKDNVDYWVLMDPVKQMLFLNSTGRVLDRDPPMNIHSIVVQVQCTNK

KVGTTIYHEVRIVVRDRNDNSPTFKHESYYATVNELTPVGTTTFTGFSGDNGATDIDDGPNGQI

EYVIQYNPDDPTSNDTFEIPLMLTGNIVLRKRLNYEDKTRYFVIIQANDRAQNLNERRTTTTTL

TVDVLDGDDLGPMFLPCVLVPNTRDCRPLTYQAAIPELRTPEELNPIIVTPPIQAIDQDRNIQP

PSDRPGTLYSILVGTPEDYPRFFHMHPRTAELSLLEPVNRDFHQKFDLVIKAEQDNGHPLPAFA

GLHIEILDENNQSPYFTMPSYQGYILESAPVGATTSDSLNLTSPLRIVALDKDIEDTKDPELHL

FLNDYTSVFTVTQTGTTRYLTLLQPVDREEQQTYTFSITAFDGVQESEPVIVNIQVMD<u>ANDN</u>AP

VFDPYLPRNLSVVEEEANAFVGQVKATDPDAGTNGQVHYSLGNFNNLFRITSNGSIYTAVKLNR

EVRDYYELVVVATDGAVHPRHSTLTLAIKVLD<u>IDDN</u>PPVFQKKFYIGGVSEDARMFTSVLRVKA

TDKDTGNYSVMAYRLIIPPIKEGKEGFVVETYTGLIKTAMLFHNMRRSYFKFQVIATDDYGKGL

SGKADVLVSVVNQLDMQVIVSNVPPTLVEKKIEDLTEILDRYVQEQIPGAKVVVESIGARRHGD

AFSLEDYTKCDLTVYAIDPQTNRAIDRNELFKFLDGKLLDINKDFQPYYGEGGRILEIRTPEAV

ISIKKRGESLGYTEGALLALAFIIILCCTPAILVVLVSYRQFKVRQAECTKTARIQAALPAAKP

AVPAPAPVAAPPPPPPPPPPGAHLYEELGDSSMHKYEMPQYGSRRRLLPPAGQEEYGEVVGEAEE

EYEEEEWARKRMIKINVDREYETSSTGEDSAPECQRNRLHHPSIHSNINGNIYIAQNGSVVRTR

RACLTDNLKVASPVRLGGPFKKLDKLAVTHEENVPLNTLSKGPFSTEKMNARPTLVTFAPCPVG

TDNTAVKPLRNRLKSTVEQESMIDSKNIKEALEFHSDHTQSDDEELWMGPWNNLHIPMTKL

An exemplary nucleic acid sequence encoding a mini-PCDH15 lacking EC5, EC6, EC8, EC9 and EC10 (V8) is set forth in SEQ ID NO: 46 (mini-PCDH15 V8: includes EC1-EC2-EC3-EC4-EC7-EC11-MAD12-TM-cyto CD1):

(SEQ ID NO: 46)
```
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAAGTCCATATTTTACAATGCCCAGTTATC

AAGGCTATATCCTGGAATCTGCCCCAGTGGGAGCAACCATTTCGGACAGTCTCAATTTGACTTC

ACCTTTAAGAATAGTAGCTCTGGACAAGGACATAGAAGATACAAAAGACCCAGAGCTTCACCTT

TTTCTGAATGACTACACCTCAGTCTTCACCGTCACACAGACTGGTATTACTCGCTACCTCACCT

TACTTCAACCAGTGGACAGGGAAGAACAGCAAACTTACACCTTTTCGATAACAGCATTTGATGG

TGTACAAGAAAGTGAGCCAGTCATCGTCAATATTCAAGTGATGGATGCAAATGATAACGCTCCA

GTGTTTGATCCTTATCTGCCAAGAAATTTATCTGTGGTGGAAGAAGAAGCCAATGCCTTTGTGG

GTCAAGTAAAAGCAACAGACCCTGATGCTGGAATAAATGGTCAAGTGCACTACAGTTTGGGTAA

CTTTAATAATCTTTTTCGTATCACATCCAATGGGAGCATTTACACAGCAGTGAAGCTTAACAGA

GAAGTCAGGGACTACTATGAACTTGTTGTTGTGGCAACAGATGGAGCAGTACACCCTCGTCATT

CAACTCTAACCTTGGCCATCAAGGTTTTGGACATTGATGATAACCCCCCAGTGTTTCAGAAAAA

ATTCTACATCGGAGGTGTATCTGAAGATGCAAGAATGTTTACTTCTGTACTCAGAGTGAAGGCT

ACTGATAAAGATACTGGCAATTATAGTGTCATGGCCTACAGACTCATAATACCACCAATTAAAG

AGGGAAAAGAAGGATTTGTAGTGGAAACATATACAGGGCTTATCAAAACTGCTATGCTCTTCCA

TAATATGAGGAGATCCTACTTCAAGTTTCAAGTTATTGCAACTGACGACTATGGGAAGGGACTG

AGCGGCAAAGCCGATGTACTCGTCTCCGTGGTCAATCAGCTGGATATGCAAGTCATTGTTTCCA

ATGTGCCTCCTACTCTAGTGGAAAAAAAGATAGAAGATCTTACAGAGATCTTGGATCGCTATGT

TCAGGAACAAATTCCTGGTGCCAAGGTCGTAGTGGAGTCCATTGGAGCTCGCCGGCATGGAGAT

GCCTTTTCCCTAGAAGATTACACCAAATGTGACTTGACTGTCTATGCAATTGACCCCCCAAACCA

ACAGAGCCATCGATAGAAATGAGCTTTTTAAATTTTTGGATGGCAAACTACTTGATATCAATAA

AGACTTTCAGCCGTATTATGGGGAAGGAGGACGCATTCTGGAGATCCGGACTCCAGAGGCAGTG

ACCAGCATTAAAAAGAGAGGAGAAAGTCTAGGATACACAGAAGGGGCCTTGTTGGCTCTGGCCT
```

-continued

```
TCATCATCATCCTCTGCTGCATTCCTGCCATCTTGGTGGTTTTGGTCAGCTACAGACAGTTTAA

AGTACGTCAAGCTGAGTGTACAAAGACTGCACGAATTCAGGCCGCATTACCCGCGGCTAAACCA

GCAGTGCCGGCTCCTGCACCAGTGGCAGCGCCCCCGCCGCCGCCGCCGCCTCCGCCAGGTGCGC

ATCTCTATGAAGAACTTGGAGACAGCTCAATGCATAATCTTTTCCTTCTCTACCATTTTCAACA

AAGCAGGGGAAATAACTCAGTCTCAGAAGACAGGAAACATCAACAAGTTGTGATGCCCTTTTCT

TCCAATACTATTGAGGCTCACAAGTCAGCTCATGTAGACGGATCACTTAAGAGCAACAAACTGA

AGTCTGCAAGAAAATTCACATTTCTATCTGATGAGGATGACTTAAGTGCCCATAATCCCCTTTA

TAAGGAAAACATAAGTCAAGTATCAACAAATTCAGACATTTCACAGAGAACAGATTTTGTAGAC

CCATTTTCACCCAAAATACAAGCCAAGAGTAAGTCTCTGAGGGGCCCAAGAGAAAGATTCAGA

GGCTGTGGAGTCAGTCAGTCAGCTTACCCAGGAGGCTGATGAGGAAAGTTCCAAATAGACCAGA

GATCATAGATCTGCAGCAGTGGCAAGGCACCAGGCAGAAAGCTGAAAATGAAAACACTGGAATC

TGTACAAACAAAAGAGGTAGCAGCAATCCATTGCTTACAACTGAAGAGGCAAATTTGACAGAGA

AAGAGGAAATAAGGCAAGGTGAAACACTGATGATAGAAGGAACAGAACAGTTGAAATCTCTCTC

TTCAGACTCTTCATTTTGCTTTCCCAGGCCTCACTTCTCATTCTCCACTTTGCCAACTGTTTCA

AGAACTGTGGAACTCAAATCAGAACCTAATGTCATCAGTTCTCCTGCTGAGTGTTCCTTGGAAC

TTTCTCCTTCAAGGCCTTGTGTTTTACATTCTTCACTCTCTAGGAGAGAGACACCTATTTGTAT

GTTACCTATTGAAACCGAAAGAAATATTTTTGAAAATTTTGCCCATCCACCCAAACATCTCTCCT

TCTGCCTGTCCCCTTCCCCCTCCTCCTCCTATTTCTCCTCCTTCTCCTCCTCCTGCTCCTGCTC

CTCTTGCTCCTCCTCCTGACATTTCTCCTTTTTCTCTTTTTTGTCCTCCTCCCTCTCCTCCTTC

TATCCCTCTTCCTCTTCCTCCTCCTACATTTTTTCCACTTTCCGTTTCAACGTCTGGTCCCCCA

ACACCACCTCTTCTACCTCCATTTCCAACTCCTCTTCCTCCACCACCTCCTTCTATTCCTTGCC

CTCCACCTCCTTCAGCTTCATTTCTGTCCACAGAGTGTGTCTGTATAACAGGTGTTAAATGCAC

GACCAACTTGATGCCTGCCGAGAAAATTAAGTCCTCTATGACACAGCTATCAACAACGACAGTG

TGTAAAACAGACCCTCAGAGAGAACCAAAAGGCATCCTCAGACACGTTAAAAACTTAGCAGAAC

TTGAAAAATCAGTAGCTAACATGTACAGTCAAATAGAAAAAAACTATCTACGCACAAATGTTTC

AGAACTTCAAACTATGTGCCCTTCAGAAGTAACAAATATGGAAATCACATCTGAACAAACAAG

GGGAGTTTGAACAATATTGTCGAGGGAACTGAAAAACAATCTCACAGTCAATCTACTTCACTGT

AA
```

An exemplary nucleic acid sequence encoding a mini-PCDH15 lacking EC5, EC6, EC8, EC9 and EC10 (V8) is set forth in SEQ ID NO: 105 (mini-PCDH15 V8: includes EC1-EC2-EC3-EC4-EC7-EC11-MAD12-TM-cyto CD2):

(SEQ ID NO: 105)
```
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA
```

-continued

```
GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAAGTCCATATTTTACAATGCCCAGTTATC

AAGGCTATATCCTGGAATCTGCCCCAGTGGGAGCAACCATTTCGGACAGTCTCAATTTGACTTC

ACCTTTAAGAATAGTAGCTCTGGACAAGGACATAGAAGATACAAAAGACCCAGAGCTTCACCTT

TTTCTGAATGACTACACCTCAGTCTTCACCGTCACACAGACTGGTATTACTCGCTACCTCACCT

TACTTCAACCAGTGGACAGGGAAGAACAGCAAACTTACACCTTTTCGATAACAGCATTTGATGG

TGTACAAGAAAGTGAGCCAGTCATCGTCAATATTCAAGTGATGGATGCAAATGATAACGCTCCA

GTGTTTGATCCTTATCTGCCAAGAAATTTATCTGTGGTGGAAGAAGAAGCCAATGCCTTTGTGG

GTCAAGTAAAAGCAACAGACCCTGATGCTGGAATAAATGGTCAAGTGCACTACAGTTTGGGTAA

CTTTAATAATCTTTTTCGTATCACATCCAATGGGAGCATTTACACAGCAGTGAAGCTTAACAGA

GAAGTCAGGGACTACTATGAACTTGTTGTTGTGGCAACAGATGGAGCAGTACACCCTCGTCATT

CAACTCTAACCTTGGCCATCAAGGTTTTGGACATTGATGATAACCCCCCAGTGTTTCAGAAAAA

ATTCTACATCGGAGGTGTATCTGAAGATGCAAGAATGTTTACTTCTGTACTCAGAGTGAAGGCT

ACTGATAAAGATACTGGCAATTATAGTGTCATGGCCTACAGACTCATAATACCACCAATTAAAG

AGGGAAAAGAAGGATTTGTAGTGGAAACATATACAGGGCTTATCAAAACTGCTATGCTCTTCCA

TAATATGAGGAGATCCTACTTCAAGTTTCAAGTTATTGCAACTGACGACTATGGGAAGGGACTG

AGCGGCAAAGCCGATGTACTCGTCTCCGTGGTCAATCAGCTGGATATGCAAGTCATTGTTTCCA

ATGTGCCTCCTACTCTAGTGGAAAAAAAGATAGAAGATCTTACAGAGATCTTGGATCGCTATGT

TCAGGAACAAATTCCTGGTGCCAAGGTCGTAGTGGAGTCCATTGGAGCTCGCCGGCATGGAGAT

GCCTTTTCCCTAGAAGATTACACCAAATGTGACTTGACTGTCTATGCAATTGACCCCCAAACCA

ACAGAGCCATCGATAGAAATGAGCTTTTTAAATTTTTGGATGGCAAACTACTTGATATCAATAA

AGACTTTCAGCCGTATTATGGGGAAGGAGGACGCATTCTGGAGATCCGGACTCCAGAGGCAGTG

ACCAGCATTAAAAAGAGAGGAGAAAGTCTAGGATACACAGAAGGGGCCTTGTTGGCTCTGGCCT

TCATCATCATCCTCTGCTGCATTCCTGCCATCTTGGTGGTTTTGGTCAGCTACAGACAGTTTAA

AGTACGTCAAGCTGAGTGTACAAAGACTGCACGAATTCAGGCCGCATTACCCGCGGCTAAACCA

GCAGTGCCGGCTCCTGCACCAGTGGCAGCGCCCCCGCCGCCGCCGCCGCCTCCGCCAGGTGCGC

ATCTCTATGAAGAACTTGGAGACAGCTCAATGCATAAGTATGAAATGCCTCAATATGGGAGTCG

CCGTCGATTGTTACCACCAGCTGGACAGGAGGAATATGGTGAGGTGGTTGGTGAAGCTGAGGAA

GAATATGAGGAGGAAGAGGAAGAGCCAAAGAAAATTAAAAAACCAAAGGTTGAAATTAGAGAGC

CTAGTGAGGAGGAAGAAGTAGTTGTAACTATCGAAAAACCACCAGCAGCTGAGCCTACATACAC

AACATGGAAGAGAGCCAGAATATTCCCCATGATTTTTAAGAAAGTTAGAGGATTAGCTGATAAA

AGAGGAATCGTTGACCTTGAGGGTGAAGAGTGGCAGAGACGCCTTGAGGAAGAAGATAAAGATT

ATTTGAAACTCACTCTGGACCAAGAGGAAGCAACAGAAAGCACTGTAGAATCAGAGGAGGAATC
```

-continued

```
CTCCAGCGACTATACTGAATACAGTGAAGAAGAGTCTGAGTTCAGTGAGTCTGAGACTACAGAA

GAGGAATCTGAGTCAGAGACACCCTCTGAGGAGGAGGAGAGTTCCACCCCTGAATCAGAAGAAT

CGGAATCCACAGAGTCAGAAGGAGAAAAAGCAAGGAAAAACATTGTGCTTGCAAGAAGAAGGCC

CATGGTTGAGGAGGTCAAGGAAGTCAAGGGTAGGAAAGAGGAGCCACAAGAAGAACAAAAGAA

CCTAAGATGGAAGAAGAAGAACACTCAGAAGAAGAAGAAAGTGGACCAGCCCCTGTGGAAGAAA

GTACAGACCCTGAAGCTCAAGATATCCCTGAAGAGGGCAGTGCAGAATCAGCTTCGGTGGAAGG

AGGTGTGGAAAGTGAGGAGGAATCAGAATCAGGTAGTAGTAGCAGTAGTAGCGAAAGTCAGTCT

GGAGGTCCATGGGGCTATCAGGTACCAGCGTATGACAGAAGCAAGAATGCAAACCAAAAGAAGT

CGCCAGGAGCAAACTCTGAAGGTTACAACACAGCACTTTGA
```

An exemplary nucleic acid sequence encoding a mini-PCDH15 lacking EC5, EC6, EC8, EC9 and EC10 (V8) is set forth in SEQ ID NO: 106 (mini-PCDH15 V8: includes EC1-EC2-EC3-EC4-EC7-EC11-MAD12-TM-cyto CD3):

```
                                              (SEQ ID NO: 106)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAAAGTCCATATTTTACAATGCCCAGTTATC

AAGGCTATATCCTGGAATCTGCCCCAGTGGGAGCAACCATTTCGGACAGTCTCAATTTGACTTC

ACCTTTAAGAATAGTAGCTCTGGACAAGGACATAGAAGATACAAAAGACCCAGAGCTTCACCTT

TTTCTGAATGACTACACCTCAGTCTTCACCGTCACACAGACTGGTATTACTCGCTACCTCACCT

TACTTCAACCAGTGGACAGGGAAGAACAGCAAACTTACACCTTTTCGATAACAGCATTTGATGG

TGTACAAGAAAGTGAGCCAGTCATCGTCAATATTCAAGTGATGGATGCAAATGATAACGCTCCA

GTGTTTGATCCTTATCTGCCAAGAAATTTATCTGTGGTGGAAGAAGAAGCCAATGCCTTTGTGG

GTCAAGTAAAAGCAACAGACCCTGATGCTGGAATAAATGGTCAAGTGCACTACAGTTTGGGTAA

CTTTAATAATCTTTTTCGTATCACATCCAATGGGAGCATTTACACAGCAGTGAAGCTTAACAGA

GAAGTCAGGGACTACTATGAACTTGTTGTTGTGGCAACAGATGGAGCAGTACACCCTCGTCATT
```

-continued

```
CAACTCTAACCTTGGCCATCAAGGTTTTGGACATTGATGATAACCCCCCAGTGTTTCAGAAAAA

ATTCTACATCGGAGGTGTATCTGAAGATGCAAGAATGTTTACTTCTGTACTCAGAGTGAAGGCT

ACTGATAAAGATACTGGCAATTATAGTGTCATGGCCTACAGACTCATAATACCACCAATTAAAG

AGGGAAAAGAAGGATTTGTAGTGGAAACATATACAGGGCTTATCAAAACTGCTATGCTCTTCCA

TAATATGAGGAGATCCTACTTCAAGTTTCAAGTTATTGCAACTGACGACTATGGGAAGGGACTG

AGCGGCAAAGCCGATGTACTCGTCTCCGTGGTCAATCAGCTGGATATGCAAGTCATTGTTTCCA

ATGTGCCTCCTACTCTAGTGGAAAAAAAGATAGAAGATCTTACAGAGATCTTGGATCGCTATGT

TCAGGAACAAATTCCTGGTGCCAAGGTCGTAGTGGAGTCCATTGGAGCTCGCCGGCATGGAGAT

GCCTTTTCCCTAGAAGATTACACCAAATGTGACTTGACTGTCTATGCAATTGACCCCCAAACCA

ACAGAGCCATCGATAGAAATGAGCTTTTTAAATTTTTGGATGGCAAACTACTTGATATCAATAA

AGACTTTCAGCCGTATTATGGGGAAGGAGGACGCATTCTGGAGATCCGGACTCCAGAGGCAGTG

ACCAGCATTAAAAAGAGAGGAGAAAGTCTAGGATACACAGAAGGGGCCTTGTTGGCTCTGGCCT

TCATCATCATCCTCTGCTGCATTCCTGCCATCTTGGTGGTTTTGGTCAGCTACAGACAGTTTAA

AGTACGTCAAGCTGAGTGTACAAAGACTGCACGAATTCAGGCCGCATTACCCGCGGCTAAACCA

GCAGTGCCGGCTCCTGCACCAGTGGCAGCGCCCCGCCGCCGCCGCCGCCTCCGCCAGGTGCGC

ATCTCTATGAAGAACTTGGAGACAGCTCAATGCATAAGTATGAAATGCCTCAATATGGGAGTCG

CCGTCGATTGTTACCACCAGCTGGACAGGAGGAATATGGTGAGGTGGTTGGTGAAGCTGAGGAA

GAATATGAGGAGGAAGAGTGGGCAAGAAAAAGAATGATCAAGTTAGTTGTTGATCGAGAGTATG

AAACCAGCTCAACTGGAGAAGACAGTGCTCCTGAATGTCAGAGAAACCGTCTTCACCATCCTAG

TATCCACAGTAATATCAACGGCAATATATATATTGCACAGAATGGTTCTGTGGTGAGAACCCGC

CGTGCCTGCCTCACGGACAACTTAAAAGTTGCTTCCCCTGTTCGACTGGGAGGGCCCTTTAAGA

AACTAGACAAGTTGGCAGTGACACATGAGGAGAATGTACCTCTGAACACATTATCAAAGGGGCC

ATTTTCTACTGAAAAAATGAATGCAAGACCAACTCTGGTTACATTTGCCCCTTGCCCTGTGGGG

ACTGACAATACAGCGGTGAAGCCACTAAGGAACAGGCTGAAAAGCACAGTTGAACAGGAGTCCA

TGATTGACAGTAAGAACATCAAGGAGGCTTTGGAATTTCATAGTGACCACACACAGTCTGATGA

TGAAGAGCTTTGGATGGGCCCCTGGAACAACCTCCATATACCAATGACAAAACTGTGA
```

In some embodiments, the mini-PCDH15 has 7 EC domains less than the full-length PCDH15. In some examples, the mini-PCDH15 lacks EC4, EC5, EC6, EC7, EC8, EC9, and EC10 domain. In some embodiments, the mini-PCDH15 includes EC1-EC2-EC3-EC11 of SEQ ID NO: 1, 53, 55, or 57. In one example, the mini-PCDH15 comprises an amino acid sequence at least 60%, 70%, 75%, 80%, 85%, 90%, 91%, 92%, 93%, 94%, 95%, 96%, 97%, 98%, 99% or 100% identical to SEQ ID NO: 71, 107 or 108. In some embodiments, the nucleic acid encoding the mini-PCDH15 lacking EC4, EC5, EC6, EC7, EC8, EC9, and EC10 is at least 60%, 70%, 75%, 80%, 85%, 90%, 91%, 92%, 93%, 94%, 95%, 96%, 97%, 98%, 99% or 100% identical to SEQ ID NO: 72, 109, or 110.

An exemplary amino acid sequence of a mini-PCDH15 lacking EC4, EC5, EC6, EC7, EC8, EC9, and EC10 (V9) is set forth in SEQ ID NO: 71 (mini-PCDH15 V9: includes EC1-EC2-EC3-EC11-MAD12-TM-cyto CD1; different domains alternating in bold and regular font):

(SEQ ID NO: 71)
MFRQFYLWTCLASGIILGSLFEICLGQYDDDWQYEDCKLARGGPPATIVAI

DEESRNGTILVDNMLIKGTAGGPDPTIELSLKDNVDYWVLMDPVKQMLFLN

STGRVLDRDPPMNIHSIVVQVQCINKKVGTIIYHEVRIVVRDRNDNSPTFK

HESYYATVNELTPVGTTIFTGFSGDNGATDIDDGPNGQIEYVIQYNPDDPT

SNDTFEIPLMLTGNIVLRKRLNYEDKTRYFVIIQANDRAQNLNERRTTTTT

LTVDVLDGDDLGPMFLPCVLVPNTRDCRPLTYQAAIPELRTPEELNPIIVT

PPIQAIDQDRNIQPPSDRPGILYSILVGTPEDYPRFFHMHPRTAELSLLEP

VNRDFHQKFDLVIKAEQDNGHPLPAFAGLHIEILDENNQPPVFQKKFYIGG

VSEDARMFTSVLRVKATDKDTGNYSVMAYRLIIPPIKEGKEGFVVETYTGL

IKTAMLFHNMRRSYFKFQVIATDDYGKGLSGKADVLVSVVNQLDMQVIVSN

VPPTLVEKKIEDLTEILDRYVQEQIPGAKVVVESIGARRHGDAFSLEDYTK

CDLTVYAIDPQTNRAIDRNELFKFLDGKLLDINKDFQPYYGEGGRILEIRT

PEAVTSIKKRGESLGYTEGALLALAFIIILCCIPAILVVLVSYRQFKVRQA

-continued

ECTKTARIQAALPAAKPAVPAPAPVAAPPPPPPPPPGAHLYEELGDSSMHN

LFLLYHFQQSRGNNSVSEDRKHQQVVMPFSSNTIEAHKSAHVDGSLKSNKL

KSARKFTFLSDEDDLSAHNPLYKENISQVSTNSDISQRTDFVDPFSPKIQA

KSKSLRGPREKIQRLWSQSVSLPRRLMRKVPNRPEIIDLQQWQGTRQKAEN

ENTGICTNKRGSSNPLLTTEEANLTEKEEIRQGETLMIEGTEQLKSLSSDS

SFCFPRPHFSFSTLPTVSRTVELKSEPNVISSPAECSLELSPSRPCVLHSS

LSRRETPICMLPIETERNIFENFAHPPNISPSACPLPPPPPISPPSPPPAP

APLAPPPDISPFSLFCPPPSPPSIPLPLPPPTFFPLSVSTSGPPTPPLLPP

FPTPLPPPPPSIPCPPPPSASFLSTECVCITGVKCTTNLMPAEKIKSSMTQ

LSTTTVCKTDPQREPKGILRHVKNLAELEKSVANMYSQIEKNYLRTNVSEL

QTMCPSEVTNMEITSEQNKGSLNNIVEGTEKQSHSQSTSL

An exemplary amino acid sequence of a mini-PCDH15 lacking EC4, EC5, EC6, EC7, EC8, EC9, and EC10 (V9) is set forth in SEQ ID NO: 107 (mini-PCDH15 V9: includes EC1-EC2-EC3-EC11-MAD12-TM-cyto CD2; different domains alternating in bold and regular font):

(SEQ ID NO: 107)
MFRQFYLWTCLASGIILGSLFEICLGQYDDDWQYEDCKLARGGPPATIVAI

DEESRNGTILVDNMLIKGTAGGPDPTIELSLKDNVDYWVLMDPVKQMLFLN

STGRVLDRDPPMNIHSIVVQVQCINKKVGTIIYHEVRIVVRDRNDNSPTFK

HESYYATVNELTPVGTTIFTGFSGDNGATDIDDGPNGQIEYVIQYNPDDPT

SNDTFEIPLMLTGNIVLRKRLNYEDKTRYFVIIQANDRAQNLNERRTTTTT

LTVDVLDGDDLGPMFLPCVLVPNTRDCRPLTYQAAIPELRTPEELNPIIVT

PPIQAIDQDRNIQPPSDRPGILYSILVGTPEDYPRFFHMHPRTAELSLLEP

VNRDFHQKFDLVIKAEQDNGHPLPAFAGLHIEILDENNQPPVFQKKFYIGG

VSEDARMFTSVLRVKATDKDTGNYSVMAYRLIIPPIKEGKEGFVVETYTGL

IKTAMLFHNMRRSYFKFQVIATDDYGKGLSGKADVLVSVVNQLDMQVIVSN

VPPTLVEKKIEDLTEILDRYVQEQIPGAKVVVESIGARRHGDAFSLEDYTK

CDLTVYAIDPQTNRAIDRNELFKFLDGKLLDINKDFQPYYGEGGRILEIRT

PEAVTSIKKRGESLGYTEGALLALAFIIILCCIPAILVVLVSYRQFKVRQA

ECTKTARIQAALPAAKPAVPAPAPVAAPPPPPPPPPGAHLYEELGDSSMHK

YEMPQYGSRRRLLPPAGQEEYGEVVGEAEEEYEEEEEPKKIKKPKVEIRE

PSEEEEVVVTIEKPPAAEPTYTTWKRARIFPMIFKKVRGLADKRGIVDLEG

-continued

EEWQRRLEEEDKDYLKLTLDQEEATESTVESEEESSSDYTEYSEEESEFSE

SETTEEESESETPSEEEESSTPESEEESESTESEGEKARKNIVLARRRPMVE

EVKEVKGRKEEPQEEQKEPKMEEEEHSEEEESGPAPVEESTDPEAQDIPEE

GSAESASVEGGVESEEESESGSSSSSSESQSGGPWGYQVPAYDRSKNANQK

KSPGANSEGYNTAL

An exemplary amino acid sequence of a mini-PCDH15 lacking EC4, EC5, EC6, EC7, EC8, EC9, and EC10 (V9) is set forth in SEQ ID NO: 108 (mini-PCDH15 V9: includes EC1-EC2-EC3-EC11-MAD12-TM-cyto CD3; different domains alternating in bold and regular font):

(SEQ ID NO: 108)
MFRQFYLWTCLASGIILGSLFEICLGQYDDDWQYEDCKLARGGPPATIVAI

DEESRNGTILVDNMLIKGTAGGPDPTIELSLKDNVDYWVLMDPVKQMLFLN

STGRVLDRDPPMNIHSIVVQVQCINKKVGTIIYHEVRIVVRDRNDNSPTFK

HESYYATVNELTPVGTTIFTGFSGDNGATDIDDGPNGQIEYVIQYNPDDPT

SNDTFEIPLMLTGNIVLRKRLNYEDKTRYFVIIQANDRAQNLNERRTTTTT

LTVDVLDGDDLGPMFLPCVLVPNTRDCRPLTYQAAIPELRTPEELNPIIVT

PPIQAIDQDRNIQPPSDRPGILYSILVGTPEDYPRFFHMHPRTAELSLLEP

VNRDFHQKFDLVIKAEQDNGHPLPAFAGLHIEILDENNQPPVFQKKFYIGG

VSEDARMFTSVLRVKATDKDTGNYSVMAYRLIIPPIKEGKEGFVVETYTGL

IKTAMLFHNMRRSYFKFQVIATDDYGKGLSGKADVLVSVVNQLDMQVIVSN

VPPTLVEKKIEDLTEILDRYVQEQIPGAKVVVESIGARRHGDAFSLEDYTK

CDLTVYAIDPQTNRAIDRNELFKFLDGKLLDINKDFQPYYGEGGRILEIRT

PEAVTSIKKRGESLGYTEGALLALAFIIILCCIPAILVVLVSYRQFKVRQA

ECTKTARIQAALPAAKPAVPAPAPVAAPPPPPPPPPGAHLYEELGDSSMHK

YEMPQYGSRRRLLPPAGQEEYGEVVGEAEEEYEEEEWARKRMIKLVVDREY

ETSSTGEDSAPECQRNRLHHPSIHSNINGNIYIAQNGSVVRTRRACLTDNL

KVASPVRLGGPFKKLDKLAVTHEENVPLNTLSKGPFSTEKMNARPTLVTFA

PCPVGTDNTAVKPLRNRLKSTVEQESMIDSKNIKEALEFHSDHTQSDDEEL

WMGPWNNLHIPMTKL

An exemplary nucleic acid sequence encoding a miniPCDH15 lacking EC4, EC5, EC6, EC7, EC8, EC9, and EC10 (V9) is set forth in SEQ ID NO: 72 (mini-PCDH15 V9: includes EC1-EC2-EC3-EC11-MAD12-TM-cyto CD1):

(SEQ ID NO: 72)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

-continued

```
CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAACCCCCAGTGTTTCAGAAAAAATTCTACA

TCGGAGGTGTATCTGAAGATGCAAGAATGTTTACTTCTGTACTCAGAGTGAAGGCTACTGATAA

AGATACTGGCAATTATAGTGTCATGGCCTACAGACTCATAATACCACCAATTAAAGAGGGAAAA

GAAGGATTTGTAGTGGAAACATATACAGGGCTTATCAAAACTGCTATGCTCTTCCATAATATGA

GGAGATCCTACTTCAAGTTTCAAGTTATTGCAACTGACGACTATGGGAAGGGACTGAGCGGCAA

AGCCGATGTACTCGTCTCCGTGGTCAATCAGCTGGATATGCAAGTCATTGTTTCCAATGTGCCT

CCTACTCTAGTGGAAAAAAAGATAGAAGATCTTACAGAGATCTTGGATCGCTATGTTCAGGAAC

AAATTCCTGGTGCCAAGGTCGTAGTGGAGTCCATTGGAGCTCGCCGGCATGGAGATGCCTTTTC

CCTAGAAGATTACACCAAATGTGACTTGACTGTCTATGCAATTGACCCCCAAACCAACAGAGCC

ATCGATAGAAATGAGCTTTTTAAATTTTTGGATGGCAAACTACTTGATATCAATAAAGACTTTC

AGCCGTATTATGGGGAAGGAGGACGCATTCTGGAGATCCGGACTCCAGAGGCAGTGACCAGCAT

TAAAAAGAGAGGAGAAAGTCTAGGATACACAGAAGGGGCCTTGTTGGCTCTGGCCTTCATCATC

ATCCTCTGCTGCATTCCTGCCATCTTGGTGGTTTTGGTCAGCTACAGACAGTTTAAAGTACGTC

AAGCTGAGTGTACAAAGACTGCACGAATTCAGGCCGCATTACCCGCGGCTAAACCAGCAGTGCC

GGCTCCTGCACCAGTGGCAGCGCCCCCGCCGCCGCCGCCGCCTCCGCCAGGTGCGCATCTCTAT

GAAGAACTTGGAGACAGCTCAATGCATAATCTTTTCCTTCTCTACCATTTTCAACAAAGCAGGG

GAAATAACTCAGTCTCAGAAGACAGGAAACATCAACAAGTTGTGATGCCCTTTTCTTCCAATAC

TATTGAGGCTCACAAGTCAGCTCATGTAGACGGATCACTTAAGAGCAACAAACTGAAGTCTGCA

AGAAAATTCACATTTCTATCTGATGAGGATGACTTAAGTGCCCATAATCCCCTTTATAAGGAAA

ACATAAGTCAAGTATCAACAAATTCAGACATTTCACAGAGAACAGATTTTGTAGACCCATTTTC

ACCCAAAATACAAGCCAAGAGTAAGTCTCTGAGGGGCCCAAGAGAAAAGATTCAGAGGCTGTGG

AGTCAGTCAGTCAGCTTACCCAGGAGGCTGATGAGGAAAGTTCCAAATAGACCAGAGATCATAG

ATCTGCAGCAGTGGCAAGGCACCAGGCAGAAAGCTGAAAATGAAAACACTGGAATCTGTACAAA

CAAAAGAGGTAGCAGCAATCCATTGCTTACAACTGAAGAGGCAAATTTGACAGAGAAAGAGGAA

ATAAGGCAAGGTGAAACACTGATGATAGAAGGAACAGAACAGTTGAAATCTCTCTCTTCAGACT

CTTCATTTTGCTTTCCCAGGCCTCACTTCTCATTCTCCACTTTGCCAACTGTTTCAAGAACTGT

GGAACTCAAATCAGAACCTAATGTCATCAGTTCTCCTGCTGAGTGTTCCTTGGAACTTTCTCCT

TCAAGGCCTTGTGTTTTACATTCTTCACTCTCTAGGAGAGAGACACCTATTTGTATGTTACCTA

TTGAAACCGAAAGAAATATTTTTGAAAATTTTGCCCATCCACCAAACATCTCTCCTTCTGCCTG
```

-continued

```
TCCCCTTCCCCCTCCTCCTCCTATTTCTCCTCCTTCTCCTCCTCCTGCTCCTGCTCCTCTTGCT

CCTCCTCCTGACATTTCTCCTTTTTCTCTTTTTTGTCCTCCTCCCTCTCCTCCTTCTATCCCTC

TTCCTCTTCCTCCTCCTACATTTTTTCCACTTTCCGTTTCAACGTCTGGTCCCCCAACACCACC

TCTTCTACCTCCATTTCCAACTCCTCTTCCTCCACCACCTCCTTCTATTCCTTGCCCTCCACCT

CCTTCAGCTTCATTTCTGTCCACAGAGTGTGTCTGTATAACAGGTGTTAAATGCACGACCAACT

TGATGCCTGCCGAGAAAATTAAGTCCTCTATGACACAGCTATCAACAACGACAGTGTGTAAAAC

AGACCCTCAGAGAGAACCAAAAGGCATCCTCAGACACGTTAAAAACTTAGCAGAACTTGAAAAA

TCAGTAGCTAACATGTACAGTCAAATAGAAAAAAACTATCTACGCACAAATGTTTCAGAACTTC

AAACTATGTGCCCTTCAGAAGTAACAAATATGGAAATCACATCTGAACAAAACAAGGGGAGTTT

GAACAATATTGTCGAGGGAACTGAAAAACAATCTCACAGTCAATCTACTTCACTGTAA
```

An exemplary nucleic acid sequence encoding a miniPCDH15 lacking EC4, EC5, EC6, EC7, EC8, EC9, and EC10 (V9) is set forth in SEQ ID NO: 109 (mini-PCDH15 V9: includes EC1-EC2-EC3-EC11-MAD12-TM-cyto CD2):

```
                                              (SEQ ID NO: 109)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAACCCCCAGTGTTTCAGAAAAAATTCTACA

TCGGAGGTGTATCTGAAGATGCAAGAATGTTTACTTCTGTACTCAGAGTGAAGGCTACTGATAA

AGATACTGGCAATTATAGTGTCATGGCCTACAGACTCATAATACCACCAATTAAAGAGGGAAAA

GAAGGATTTGTAGTGGAAACATATACAGGGCTTATCAAAACTGCTATGCTCTTCCATAATATGA

GGAGATCCTACTTCAAGTTTCAAGTTATTGCAACTGACGACTATGGGAAGGGACTGAGCGGCAA

AGCCGATGTACTCGTCTCCGTGGTCAATCAGCTGGATATGCAAGTCATTGTTTCCAATGTGCCT

CCTACTCTAGTGGAAAAAAAGATAGAAGATCTTACAGAGATCTTGGATCGCTATGTTCAGGAAC

AAATTCCTGGTGCCAAGGTCGTAGTGGAGTCCATTGGAGCTCGCCGGCATGGAGATGCCTTTTC
```

-continued

```
CCTAGAAGATTACACCAAATGTGACTTGACTGTCTATGCAATTGACCCCCAAACCAACAGAGCC

ATCGATAGAAATGAGCTTTTTAAATTTTTGGATGGCAAACTACTTGATATCAATAAAGACTTTC

AGCCGTATTATGGGGAAGGAGGACGCATTCTGGAGATCCGGACTCCAGAGGCAGTGACCAGCAT

TAAAAAGAGAGGAGAAAGTCTAGGATACACAGAA

GGGGCCTTGTTGGCTCTGGCCTTCATCATCATCCTCTGCTGCATTCCTGCCATCTTGGTGGTTT

TGGTCAGCTACAGACAGTTTAAAGTACGTCAAGCTGAGTGTACAAAGACTGCACGAATTCAGGC

CGCATTACCCGCGGCTAAACCAGCAGTGCCGGCTCCTGCACCAGTGGCAGCGCCCCGCCGCCG

CCGCCGCCTCCGCCAGGTGCGCATCTCTATGAAGAACTTGGAGACAGCTCAATGCATAAGTATG

AAATGCCTCAATATGGGAGTCGCCGTCGATTGTTACCACCAGCTGGACAGGAGGAATATGGTGA

GGTGGTTGGTGAAGCTGAGGAAGAATATGAGGAGGAAGAGGAAGAGCCAAAGAAAATTAAAAAA

CCAAAGGTTGAAATTAGAGAGCCTAGTGAGGAGGAAGAAGTAGTTGTAACTATCGAAAAACCAC

CAGCAGCTGAGCCTACATACACAACATGGAAGAGAGCCAGAATATTCCCCATGATTTTTAAGAA

AGTTAGAGGATTAGCTGATAAAAGAGGAATCGTTGACCTTGAGGGTGAAGAGTGGCAGAGACGC

CTTGAGGAAGAAGATAAAGATTATTTGAAACTCACTCTGGACCAAGAGGAAGCAACAGAAAGCA

CTGTAGAATCAGAGGAGGAATCCTCCAGCGACTATACTGAATACAGTGAAGAAGAGTCTGAGTT

CAGTGAGTCTGAGACTACAGAAGAGGAATCTGAGTCAGAGACACCCTCTGAGGAGGAGGAGAGT

TCCACCCCTGAATCAGAAGAATCGGAATCCACAGAGTCAGAAGGAGAAAAAGCAAGGAAAAACA

TTGTGCTTGCAAGAAGAAGGCCCATGGTTGAGGAGGTCAAGGAAGTCAAGGGTAGGAAAGAGGA

GCCACAAGAAGAACAAAAAGAACCTAAGATGGAAGAAGAAGAACACTCAGAAGAAGAAGAAAGT

GGACCAGCCCCTGTGGAAGAAAGTACAGACCCTGAAGCTCAAGATATCCCTGAAGAGGGCAGTG

CAGAATCAGCTTCGGTGGAAGGAGGTGTGGAAAGTGAGGAGGAATCAGAATCAGGTAGTAGTAG

CAGTAGTAGCGAAAGTCAGTCTGGAGGTCCATGGGGCTATCAGGTACCAGCGTATGACAGAAGC

AAGAATGCAAACCAAAAGAAGTCGCCAGGAGCAAACTCTGAAGGTTACAACACAGCACTTTGA
```

An exemplary nucleic acid sequence encoding a miniPCDH15 lacking EC4, EC5, EC6, EC7, EC8, EC9, and EC10 (V9) is set forth in SEQ ID NO: 110 (mini-PCDH15 V9: includes EC1-EC2-EC3-EC11-MAD12-TM-cyto CD3):

```
                                                    (SEQ ID NO: 110)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC
```

-continued

```
ACAGTGGATGTTCTGGATGGAGATGACTTGGGTCCAATGTTTCTTCCTTGTGTCCTTGTGCCAA

ACACTCGTGATTGCCGTCCACTCACTTATCAAGCTGCCATACCTGAGTTGAGAACTCCGGAAGA

ACTGAACCCCATTATTGTTACGCCACCAATCCAAGCCATTGATCAGGACCGGAATATTCAACCG

CCATCAGATAGGCCAGGAATCCTCTATTCCATCCTTGTTGGGACTCCTGAGGATTACCCACGAT

TTTTCCATATGCATCCTAGGACAGCAGAACTTAGTCTCCTGGAGCCAGTAAACAGAGACTTTCA

CCAGAAATTTGATTTGGTTATTAAGGCTGAACAAGACAATGGTCATCCTCTTCCTGCCTTTGCC

GGTCTACACATTGAAATACTGGATGAAAACAATCAACCCCCAGTGTTTCAGAAAAAATTCTACA

TCGGAGGTGTATCTGAAGATGCAAGAATGTTTACTTCTGTACTCAGAGTGAAGGCTACTGATAA

AGATACTGGCAATTATAGTGTCATGGCCTACAGACTCATAATACCACCAATTAAAGAGGGAAAA

GAAGGATTTGTAGTGGAAACATATACAGGGCTTATCAAAACTGCTATGCTCTTCCATAATATGA

GGAGATCCTACTTCAAGTTTCAAGTTATTGCAACTGACGACTATGGGAAGGGACTGAGCGGCAA

AGCCGATGTACTCGTCTCCGTGGTCAATCAGCTGGATATGCAAGTCATTGTTTCCAATGTGCCT

CCTACTCTAGTGGAAAAAAAGATAGAAGATCTTACAGAGATCTTGGATCGCTATGTTCAGGAAC

AAATTCCTGGTGCCAAGGTCGTAGTGGAGTCCATTGGAGCTCGCCGGCATGGAGATGCCTTTTC

CCTAGAAGATTACACCAAATGTGACTTGACTGTCTATGCAATTGACCCCCAAACCAACAGAGCC

ATCGATAGAAATGAGCTTTTTAAATTTTTGGATGGCAAACTACTTGATATCAATAAAGACTTTC

AGCCGTATTATGGGGAAGGAGGACGCATTCTGGAGATCCGGACTCCAGAGGCAGTGACCAGCAT

TAAAAAGAGAGGAGAAAGTCTAGGATACACAGAAGGGGCCTTGTTGGCTCTGGCCTTCATCATC

ATCCTCTGCTGCATTCCTGCCATCTTGGTGGTTTTGGTCAGCTACAGACAGTTTAAAGTACGTC

AAGCTGAGTGTACAAAGACTGCACGAATTCAGGCCGCATTACCCGCGGCTAAACCAGCAGTGCC

GGCTCCTGCACCAGTGGCAGCGCCCCCGCCGCCGCCGCCGCCTCCGCCAGGTGCGCATCTCTAT

GAAGAACTTGGAGACAGCTCAATGCATAAGTATGAAATGCCTCAATATGGGAGTCGCCGTCGAT

TGTTACCACCAGCTGGACAGGAGGAATATGGTGAGGTGGTTGGTGAAGCTGAGGAAGAATATGA

GGAGGAAGAGTGGGCAAGAAAAAGAATGATCAAGTTAGTTGTTGATCGAGAGTATGAAACCAGC

TCAACTGGAGAAGACAGTGCTCCTGAATGTCAGAGAAACCGTCTTCACCATCCTAGTATCCACA

GTAATATCAACGGCAATATATATATTGCACAGAATGGTTCTGTGGTGAGAACCCGCCGTGCCTG

CCTCACGGACAACTTAAAAGTTGCTTCCCCTGTTCGACTGGGAGGGCCCTTTAAGAAACTAGAC

AAGTTGGCAGTGACACATGAGGAGAATGTACCTCTGAACACATTATCAAAGGGGCCATTTTCTA

CTGAAAAAATGAATGCAAGACCAACTCTGGTTACATTTGCCCCTTGCCCTGTGGGGACTGACAA

TACAGCGGTGAAGCCACTAAGGAACAGGCTGAAAAGCACAGTTGAACAGGAGTCCATGATTGAC

AGTAAGAACATCAAGGAGGCTTTGGAATTTCATAGTGACCACACACAGTCTGATGATGAAGAGC

TTTGGATGGGCCCCTGGAACAACCTCCATATACCAATGACAAAACTGTGA
```

In some embodiments, the mini-PCDH15 has 8 EC domains less than the full-length PCDH15. In some examples, the mini-PCDH15 lacks EC3, EC4, EC5, EC6, EC7, EC8, EC9, and EC10 domain. In some embodiments, the mini-PCDH15 includes EC1-EC2-EC11 of SEQ ID NO: 1, 53, 55, or 57. In one example, the mini-PCDH15 comprises an amino acid sequence at least 60%, 70%, 75%, 80%, 85%, 90%, 91%, 92%, 93%, 94%, 95%, 96%, 97%, 98%, 99% or 100% identical to SEQ ID NO: 73, 111 or 112. In some embodiments, the nucleic acid encoding the mini-PCDH15 lacking EC4, EC5, EC6, EC7, EC8, EC9, and EC10 is at least 60%, 70%, 75%, 80%, 85%, 90%, 91%, 92%, 93%, 94%, 95%, 96%, 97%, 98%, 99% or 100% identical to SEQ ID NO: 74, 113 or 114.

An exemplary amino acid sequence of a miniPCDH15 lacking EC3, EC4, EC5, EC6, EC7, EC8, EC9, and EC10 (V10) is set forth in SEQ ID NO: 73 (mini-PCDH15 V10: includes EC1-EC2-EC11-MAD12-TM-cyto CD1; different domains alternating in bold and regular font):

(SEQ ID NO: 73)
MFRQFYLWTCLASGIILGSLFEICLGQYDDDWQYEDCKLARGGPPATIVAI

DEESRNGTILVDNMLIKGTAGGPDPTIELSLKDNVDYWVLMDPVKQMLFLN

STGRVLDRDPPMNIHSIVVQVQCINKKVGTIIYHEVRIVVRDRNDNSPTFK

-continued

HESYYATVNELTPVGTTIFTGFSGDNGATDIDDGPNGQIEYVIQYNPDDPT

SNDTFEIPLMLTGNIVLRKRLNYEDKTRYFVIIQANDRAQNLNERRTTTTT

LTVDVL<u>DGDDL</u>PPVFQKKFYIGGVSEDARMFTSVLRVKATDKDTGNYSVMA

YRLIIPPIKEGKEGFVVETYTGLIKTAMLFHNMRRSYFKFQVIATDDYGKG

LSGKADVLVSVVNQLDMQVIVSNVPPTLVEKKIEDLTEILDRYVQEQIPGA

KVVVESIGARRHGDAFSLEDYTKCDLTVYAIDPQTNRAIDRNELFKFLDGK

LLDINKDFQPYYGEGGRILEIRTPEAVTSIKKRGESLGYTEGALLALAFII

ILCCIPAILVVLVSYRQFKVRQAECTKTARIQAALPAAKPAVPAPAPVAAP

PPPPPPPPGAHLYEELGDSSMHNLFLLYHFQQSRGNNSVSEDRKHQQVVMP

FSSNTIEAHKSAHVDGSLKSNKLKSARKFTFLSDEDDLSAHNPLYKENISQ

VSTNSDISQRTDFVDPFSPKIQAKSKSLRGPREKIQRLWSQSVSLPRRLMR

KVPNRPEIIDLQQWQGTRQKAENENTGICTNKRGSSNPLLTTEEANLTEKE

EIRQGETLMIEGTEQLKSLSSDSSFCFPRPHFSFSTLPTVSRTVELKSEPN

VISSPAECSLELSPSRPCVLHSSLSRRETPICMLPIETERNIFENFAHPPN

ISPSACPLPPPPISPPSPPPAPAPLAPPPDISPFSLFCPPPSPPSIPLPL

PPPTFFPLSVSTSGPPTPPLLPPFPTPLPPPPPSIPCPPPPSASFLSTECV

CITGVKCTTNLMPAEKIKSSMTQLSTTTVCKTDPQREPKGILRHVKNLAEL

EKSVANMYSQIEKNYLRTNVSELQTMCPSEVTNMEITSEQNKGSLNNIVEG

TEKQSHSQSTSL

An exemplary amino acid sequence of a miniPCDH15 lacking EC3, EC4, EC5, EC6, EC7, EC8, EC9, and EC10 (V10) is set forth in SEQ ID NO: 111 (mini-PCDH15 V10: includes EC1-EC2-EC11-MAD12-TM-cyto CD2; different domains alternating in bold and regular font):

(SEQ ID NO: 111)
MFRQFYLWTCLASGIILGSLFEICLGQYDDDWQYEDCKLARGGPPATIVAI

DEESRNGTILVDNMLIKGTAGGPDPTIELSLKDNVDYWVLMDPVKQMLFLN

STGRVLDRDPPMNIHSIVVQVQCINKKVGTIIYHEVRIVVRDRNDNSPTFK

HESYYATVNELTPVGTTIFTGFSGDNGATDIDDGPNGQIEYVIQYNPDDPT

SNDTFEIPLMLTGNIVLRKRLNYEDKTRYFVIIQANDRAQNLNERRTTTTT

LTVDVL<u>DGDDL</u>PFVFQKKFYIGGVSEDARMFTSVLRVKATDKDTGNYSVMA

YRLIIPPIKEGKEGFVVETYTGLIKTAMLFHNMRRSYFKFQVIATDDYGKG

LSGKADVLVSVVNQLDMQVIVSNVPPTLVEKKIEDLTEILDRYVQEQIPGA

KVVVESIGARRHGDAFSLEDYTKCDLTVYAIDPQTNRAIDRNELFKFLDGK

LLDINKDFQPYYGEGGRILEIRTPEAVTSIKKRGESLGYTEGALLALAFII

ILCCIPAILVVLVSYRQFKVRQAECTKTARIQAALPAAKPAVPAPAPVAAP

PPPPPPPPGAHLYEELGDSSMHKYEMPQYGSRRRLLPPAGQEEYGEVVGEA

EEEYEEEEEPKKIKKPKVEIREPSEEEEVVVTIEKPPAAEPTYTTWKRAR

IFPMIFKKVRGLADKRGIVDLEGEEWQRRLEEEDKDYLKLTLDQEEATEST

VESEEESSSDYTEYSEEESEFSESETTEEESESETPSEEEESSTPESEESE

STESEGEKARKNIVLARRRPMVEEVKEVKGRKEEPQEEQKEPKMEEEEHSE

EEESGPAPVEESTDPEAQDIPEEGSAESASVEGGVESEEESESGSSSSSSE

-continued

SQSGGPWGYQVPAYDRSKNANQKKSPGANSEGYNTALGALLALAFIIILCC

IPAILVVLVSYRQFKVRQAECTKTARIQAALPAAKPAVPAPAPVAAPPPPP

PPPPGAHLYEELGDSSMHKYEMPQYGSRRRLLPPAGQEEYGEVVGEAEEEY

EEEEEEPKKIKKPKVEIREPSEEEEVVVTIEKPPAAEPTYTTWKRARIFPM

IFKKVRGLADKRGIVDLEGEEWQRRLEEEDKDYLKLTLDQEEATESTVESE

EESSSDYTEYSEEESEFSESETTEEESESETPSEEEESSTPESEESESTES

EGEKARKNIVLARRRPMVEEVKEVKGRKEEPQEEQKEPKMEEEEHSEEEES

GPAPVEESTDPEAQDIPEEGSAESASVEGGVESEEESESGSSSSSSESQSG

GPWGYQVPAYDRSKNANQKKSPGANSEGYNTAL

An exemplary amino acid sequence of a miniPCDH15 lacking EC3, EC4, EC5, EC6, EC7, EC8, EC9, and EC10 (V10) is set forth in SEQ ID NO: 112 (mini-PCDH15 V10: includes EC1-EC2-EC11-MAD12-TM-cyto CD3; different domains alternating in bold and regular font):

(SEQ ID NO: 112)
MFRQFYLWTCLASGIILGSLFEICLGQYDDDWQYEDCKLARGGPPATIVAI

DEESRNGTILVDNMLIKGTAGGPDPTIELSLKDNVDYWVLMDPVKQMLFLN

STGRVLDRDPPMNIHSIVVQVQCINKKVGTIIYHEVRIVVRDRNDNSPTFK

HESYYATVNELTPVGTTIFTGFSGDNGATDIDDGPNGQIEYVIQYNPDDPT

SNDTFEIPLMLTGNIVLRKRLNYEDKTRYFVIIQANDRAQNLNERRTTTTT

LTVDVL<u>DGDDL</u>PPVFQKKFYIGGVSEDARMFTSVLRVKATDKDTGNYSVMA

YRLIIPPIKEGKEGFVVETYTGLIKTAMLFHNMRRSYFKFQVIATDDYGKG

LSGKADVLVSVVNQLDMQVIVSNVPPTLVEKKIEDLTEILDRYVQEQIPGA

KVVVESIGARRHGDAFSLEDYTKCDLTVYAIDPQTNRAIDRNELFKFLDGK

LLDINKDFQPYYGEGGRILEIRTPEAVTSIKKRGESLGYTEGALLALAFII

ILCCIPAILVVLVSYRQFKVRQAECTKTARIQAALPAAKPAVPAPAPVAAP

PPPPPPPPGAHLYEELGDSSMHKYEMPQYGSRRRLLPPAGQEEYGEVVGEA

EEEYEEEEWARKRMIKLVVDREYETSSTGEDSAPECQRNRLHHPSIHSNIN

GNIYIAQNGSVVRTRRACLTDNLKVASPVRLGGPFKKLDKLAVTHEENVPL

NTLSKGPFSTEKMNARPTLVTFAPCPVGTDNTAVKPLRNRLKSTVEQESMI

DSKNIKEALEFHSDHTQSDDEELWMGPWNNLHIPMTKLGALLALAFIIILC

CIPAILVVLVSYRQFKVRQAECTKTARIQAALPAAKPAVPAPAPVAAPPPP

PPPPGAHLYEELGDSSMHKYEMPQYGSRRRLLPPAGQEEYGEVVGEAEEE

YEEEEWARKRMIKLVVDREYETSSTGEDSAPECQRNRLHHPSIHSNINGNI

YIAQNGSVVRTRRACLTDNLKVASPVRLGGPFKKLDKLAVTHEENVPLNTL

SKGPFSTEKMNARPTLVTFAPCPVGTDNTAVKPLRNRLKSTVEQESMIDSK

NIKEALEFHSDHTQSDDEELWMGPWNNLHIPMTKL

An exemplary nucleic acid sequence encoding a miniPCDH15 lacking EC3, EC4, EC5, EC6, EC7, EC8, EC9, and EC10 (V10) is set forth in SEQ ID NO: 74 (mini-PCDH15 V9: includes EC1-EC2-EC11-MAD12-TM-cyto CD1):

(SEQ ID NO: 74)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGCCCCCAGTGTTTCAGAAAAAATTCTACATCGGAG

GTGTATCTGAAGATGCAAGAATGTTTACTTCTGTACTCAGAGTGAAGGCTACTGATAAAGATAC

TGGCAATTATAGTGTCATGGCCTACAGACTCATAATACCACCAATTAAAGAGGGAAAAGAAGGA

TTTGTAGTGGAAACATATACAGGGCTTATCAAAACTGCTATGCTCTTCCATAATATGAGGAGAT

CCTACTTCAAGTTTCAAGTTATTGCAACTGACGACTATGGGAAGGGACTGAGCGGCAAAGCCGA

TGTACTCGTCTCCGTGGTCAATCAGCTGGATATGCAAGTCATTGTTTCCAATGTGCCTCCTACT

CTAGTGGAAAAAAAGATAGAAGATCTTACAGAGATCTTGGATCGCTATGTTCAGGAACAAATTC

CTGGTGCCAAGGTCGTAGTGGAGTCCATTGGAGCTCGCCGGCATGGAGATGCCTTTTCCCTAGA

AGATTACACCAAATGTGACTTGACTGTCTATGCAATTGACCCCCAAACCAACAGAGCCATCGAT

AGAAATGAGCTTTTTAAATTTTTGGATGGCAAACTACTTGATATCAATAAAGACTTTCAGCCGT

ATTATGGGGAAGGAGGACGCATTCTGGAGATCCGGACTCCAGAGGCAGTGACCAGCATTAAAAA

GAGAGGAGAAAGTCTAGGATACACAGAAGGGGCCTTGTTGGCTCTGGCCTTCATCATCATCCTC

TGCTGCATTCCTGCCATCTTGGTGGTTTTGGTCAGCTACAGACAGTTTAAAGTACGTCAAGCTG

AGTGTACAAAGACTGCACGAATTCAGGCCGCATTACCCGCGGCTAAACCAGCAGTGCCGGCTCC

TGCACCAGTGGCAGCGCCCCCGCCGCCGCCGCCGCCTCCGCCAGGTGCGCATCTCTATGAAGAA

CTTGGAGACAGCTCAATGCATAATCTTTTCCTTCTCTACCATTTTCAACAAAGCAGGGGAAATA

ACTCAGTCTCAGAAGACAGGAAACATCAACAAGTTGTGATGCCCTTTTCTTCCAATACTATTGA

GGCTCACAAGTCAGCTCATGTAGACGGATCACTTAAGAGCAACAAACTGAAGTCTGCAAGAAAA

TTCACATTTCTATCTGATGAGGATGACTTAAGTGCCCATAATCCCCTTTATAAGGAAAACATAA

GTCAAGTATCAACAAATTCAGACATTTCACAGAGAACAGATTTTGTAGACCCATTTTCACCCAA

AATACAAGCCAAGAGTAAGTCTCTGAGGGGCCCAAGAGAAAAGATTCAGAGGCTGTGGAGTCAG

TCAGTCAGCTTACCCAGGAGGCTGATGAGGAAAGTTCCAAATAGACCAGAGATCATAGATCTGC

AGCAGTGGCAAGGCACCAGGCAGAAAGCTGAAAATGAAAACACTGGAATCTGTACAAACAAAAG

AGGTAGCAGCAATCCATTGCTTACAACTGAAGAGGCAAATTTGACAGAGAAAGAGGAAATAAGG

CAAGGTGAAACACTGATGATAGAAGGAACAGAACAGTTGAAATCTCTCTCTTCAGACTCTTCAT

TTTGCTTTCCCAGGCCTCACTTCTCATTCTCCACTTTGCCAACTGTTTCAAGAACTGTGGAACT

CAAATCAGAACCTAATGTCATCAGTTCTCCTGCTGAGTGTTCCTTGGAACTTTCTCCTTCAAGG

CCTTGTGTTTTACATTCTTCACTCTCTAGGAGAGAGACACCTATTTGTATGTTACCTATTGAAA

-continued

CCGAAAGAAATATTTTTGAAAATTTTGCCCATCCACCAAACATCTCTCCTTCTGCCTGTCCCCT

TCCCCCTCCTCCTCCTATTTCTCCTCCTTCTCCTCCTCCTGCTCCTGCTCCTCTTGCTCCTCCT

CCTGACATTTCTCCTTTTTCTCTTTTTTGTCCTCCTCCCTCTCCTCCTTCTATCCCTCTTCCTC

TTCCTCCTCCTACATTTTTTCCACTTTCCGTTTCAACGTCTGGTCCCCCAACACCACCTCTTCT

ACCTCCATTTCCAACTCCTCTTCCTCCACCACCTCCTTCTATTCCTTGCCCTCCACCTCCTTCA

GCTTCATTTCTGTCCACAGAGTGTGTCTGTATAACAGGTGTTAAATGCACGACCAACTTGATGC

CTGCCGAGAAAATTAAGTCCTCTATGACACAGCTATCAACAACGACAGTGTGTAAAACAGACCC

TCAGAGAGAACCAAAAGGCATCCTCAGACACGTTAAAAACTTAGCAGAACTTGAAAAATCAGTA

GCTAACATGTACAGTCAAATAGAAAAAAACTATCTACGCACAAATGTTTCAGAACTTCAAACTA

TGTGCCCTTCAGAAGTAACAAATATGGAAATCACATCTGAACAAACAAGGGGAGTTTGAACAA

TATTGTCGAGGGAACTGAAAAACAATCTCACAGTCAATCTACTTCACTGTAA

An exemplary nucleic acid sequence encoding a [20] miniPCDH15 lacking EC3, EC4, EC5, EC6, EC7, EC8, EC9, and EC10 (V10) is set forth in SEQ ID NO: 113 (mini-PCDH15 V9: includes EC1-EC2-EC11-MAD12-TM-cyto CD2):

(SEQ ID NO: 113)
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGCCCCCAGTGTTTCAGAAAAAATTCTACATCGGAG

GTGTATCTGAAGATGCAAGAATGTTTACTTCTGTACTCAGAGTGAAGGCTACTGATAAAGATAC

TGGCAATTATAGTGTCATGGCCTACAGACTCATAATACCACCAATTAAAGAGGGAAAAGAAGGA

TTTGTAGTGGAAACATATACAGGGCTTATCAAAACTGCTATGCTCTTCCATAATATGAGGAGAT

CCTACTTCAAGTTTCAAGTTATTGCAACTGACGACTATGGGAAGGGACTGAGCGGCAAAGCCGA

TGTACTCGTCTCCGTGGTCAATCAGCTGGATATGCAAGTCATTGTTTCCAATGTGCCTCCTACT

CTAGTGAAAAAAAGATAGAAGATCTTACAGAGATCTTGGATCGCTATGTTCAGGAACAAATTC

CTGGTGCCAAGGTCGTAGTGGAGTCCATTGGAGCTCGCCGGCATGGAGATGCCTTTTCCCTAGA

AGATTACACCAAATGTGACTTGACTGTCTATGCAATTGACCCCCAAACCAACAGAGCCATCGAT

AGAAATGAGCTTTTTAAATTTTTGGATGGCAAACTACTTGATATCAATAAAGACTTTCAGCCGT

ATTATGGGAAGGAGGACGCATTCTGGAGATCCGGACTCCAGAGGCAGTGACCAGCATTAAAAA

GAGAGGAGAAAGTCTAGGATACACAGAAGGGGCCTTGTTGGCTCTGGCCTTCATCATCATCCTC

TGCTGCATTCCTGCCATCTTGGTGGTTTTGGTCAGCTACAGACAGTTTAAAGTACGTCAAGCTG

-continued

```
AGTGTACAAAGACTGCACGAATTCAGGCCGCATTACCCGCGGCTAAACCAGCAGTGCCGGCTCC

TGCACCAGTGGCAGCGCCCCCGCCGCCGCCGCCGCCTCCGCCAGGTGCGCATCTCTATGAAGAA

CTTGGAGACAGCTCAATGCATAAGTATGAAATGCCTCAATATGGGAGTCGCCGTCGATTGTTAC

CACCAGCTGGACAGGAGGAATATGGTGAGGTGGTTGGTGAAGCTGAGGAAGAATATGAGGAGGA

AGAGGAAGAGCCAAAGAAAATTAAAAAACCAAAGGTTGAAATTAGAGAGCCTAGTGAGGAGGAA

GAAGTAGTTGTAACTATCGAAAAACCACCAGCAGCTGAGCCTACATACACAACATGGAAGAGAG

CCAGAATATTCCCCATGATTTTTAAGAAAGTTAGAGGATTAGCTGATAAAAGAGGAATCGTTGA

CCTTGAGGGTGAAGAGTGGCAGAGACGCCTTGAGGAAGAAGATAAAGATTATTTGAAACTCACT

CTGGACCAAGAGGAAGCAACAGAAAGCACTGTAGAATCAGAGGAGGAATCCTCCAGCGACTATA

CTGAATACAGTGAAGAAGAGTCTGAGTTCAGTGAGTCTGAGACTACAGAAGAGGAATCTGAGTC

AGAGACACCCTCTGAGGAGGAGGAGAGTTCCACCCCTGAATCAGAAGAATCGGAATCCACAGAG

TCAGAAGGAGAAAAAGCAAGGAAAAACATTGTGCTTGCAAGAAGAAGGCCCATGGTTGAGGAGG

TCAAGGAAGTCAAGGGTAGGAAAGAGGAGCCACAAGAAGAACAAAAAGAACCTAAGATGGAAGA

AGAAGAACACTCAGAAGAAGAAGAAAGTGGACCAGCCCCTGTGGAAGAAAGTACAGACCCTGAA

GCTCAAGATATCCCTGAAGAGGGCAGTGCAGAATCAGCTTCGGTGGAAGGAGGTGTGGAAAGTG

AGGAGGAATCAGAATCAGGTAGTAGTAGCAGTAGTAGCGAAAGTCAGTCTGGAGGTCCATGGGG

CTATCAGGTACCAGCGTATGACAGAAGCAAGAATGCAAACCAAAAGAAGTCGCCAGGAGCAAAC

TCTGAAGGTTACAACACAGCACTTTGA
```

An exemplary nucleic acid sequence encoding a miniPCDH15 lacking EC3, EC4, EC5, EC6, EC7, EC8, EC9, and EC10 (V10) is set forth in SEQ ID NO: 114 (mini-PCDH15 V9: includes EC1-EC2-EC11-MAD12-TM-cyto CD3):

(SEQ ID NO: 114)

```
ATGTTTCGACAGTTTTATCTCTGGACATGTTTAGCTTCAGGGATCATCCTGGGCTCTCTCTTTG

AAATCTGCTTGGGCCAGTATGATGATGACTGGCAATATGAGGATTGCAAACTAGCTAGGGGAGG

ACCACCAGCTACCATAGTTGCTATTGATGAAGAAAGTCGGAATGGTACAATTCTGGTGGACAAC

ATGCTGATCAAAGGGACTGCTGGAGGACCAGACCCCCACCATAGAACTTTCTTTAAAGGATAATG

TGGATTACTGGGTGTTGATGGATCCTGTTAAGCAAATGCTTTTCCTGAACAGCACCGGAAGAGT

TCTGGATAGAGATCCACCGATGAACATACACTCCATTGTGGTGCAGGTCCAGTGCATCAACAAA

AAAGTGGGCACTATTATCTACCATGAAGTGCGAATAGTGGTGAGAGACAGGAATGACAACTCAC

CCACTTTCAAGCATGAAAGCTACTATGCCACAGTGAATGAGCTCACTCCAGTTGGTACCACAAT

ATTCACAGGATTTTCAGGAGACAATGGAGCTACAGATATAGATGATGGACCAAATGGACAGATA

GAGTATGTTATTCAGTATAATCCAGATGATCCGACATCCAATGACACCTTTGAAATTCCCCTAA

TGTTGACTGGAAATATAGTGTTAAGGAAGAGGCTCAACTATGAAGATAAGACTCGCTACTTTGT

CATAATCCAAGCTAATGACCGTGCCCAAAATCTGAATGAGAGGCGAACCACCACCACCACTCTC

ACAGTGGATGTTCTGGATGGAGATGACTTGCCCCCAGTGTTTCAGAAAAAATTCTACATCGGAG

GTGTATCTGAAGATGCAAGAATGTTTACTTCTGTACTCAGAGTGAAGGCTACTGATAAAGATAC

TGGCAATTATAGTGTCATGGCCTACAGACTCATAATACCACCAATTAAAGAGGGAAAAGAAGGA

TTTGTAGTGGAAACATATACAGGGCTTATCAAAACTGCTATGCTCTTCCATAATATGAGGAGAT

CCTACTTCAAGTTTCAAGTTATTGCAACTGACGACTATGGGAAGGGACTGAGCGGCAAAGCCGA
```

```
-continued
TGTACTCGTCTCCGTGGTCAATCAGCTGGATATGCAAGTCATTGTTTCCAATGTGCCTCCTACT

CTAGTGGAAAAAAAGATAGAAGATCTTACAGAGATCTTGGATCGCTATGTTCAGGAACAAATTC

CTGGTGCCAAGGTCGTAGTGGAGTCCATTGGAGCTCGCCGGCATGGAGATGCCTTTTCCCTAGA

AGATTACACCAAATGTGACTTGACTGTCTATGCAATTGACCCCCAAACCAACAGAGCCATCGAT

AGAAATGAGCTTTTTAAATTTTTGGATGGCAAACTACTTGATATCAATAAAGACTTTCAGCCGT

ATTATGGGGAAGGAGGACGCATTCTGGAGATCCGGACTCCAGAGGCAGTGACCAGCATTAAAAA

GAGAGGAGAAAGTCTAGGATACACAGAAGGGGCCTTGTTGGCTCTGGCCTTCATCATCATCCTC

TGCTGCATTCCTGCCATCTTGGTGGTTTTGGTCAGCTACAGACAGTTTAAAGTACGTCAAGCTG

AGTGTACAAAGACTGCACGAATTCAGGCCGCATTACCCGCGGCTAAACCAGCAGTGCCGGCTCC

TGCACCAGTGGCAGCGCCCCCGCCGCCGCCGCCGCCTCCGCCAGGTGCGCATCTCTATGAAGAA

CTTGGAGACAGCTCAATGCATAAGTATGAAATGCCTCAATATGGGAGTCGCCGTCGATTGTTAC

CACCAGCTGGACAGGAGGAATATGGTGAGGTGGTTGGTGAAGCTGAGGAAGAATATGAGGAGGA

AGAGTGGGCAAGAAAAGAATGATCAAGTTAGTTGTTGATCGAGAGTATGAAACCAGCTCAACT

GGAGAAGACAGTGCTCCTGAATGTCAGAGAAACCGTCTTCACCATCCTAGTATCCACAGTAATA

TCAACGGCAATATATATATTGCACAGAATGGTTCTGTGGTGAGAACCCGCCGTGCCTGCCTCAC

GGACAACTTAAAAGTTGCTTCCCCTGTTCGACTGGGAGGGCCCTTTAAGAAACTAGACAAGTTG

GCAGTGACACATGAGGAGAATGTACCTCTGAACACATTATCAAAGGGGCCATTTTCTACTGAAA

AAATGAATGCAAGACCAACTCTGGTTACATTTGCCCCTTGCCCTGTGGGGACTGACAATACAGC

GGTGAAGCCACTAAGGAACAGGCTGAAAAGCACAGTTGAACAGGAGTCCATGATTGACAGTAAG

AACATCAAGGAGGCTTTGGAATTTCATAGTGACCACACACAGTCTGATGATGAAGAGCTTTGGA

TGGGCCCCTGGAACAACCTCCATATACCAATGACAAAACTGTGA
```

In a full-length PCDH15 protein, the last five amino acids of an EC domain immediately preceding the next EC domain is the linking region between the two EC domains (linkers). Depending on the amino acid sequences of these linkers, they can be flexible or rigid. Some linkers may have different calcium ion binding capacities (e.g., from 0 to 3 $Ca^{2+}$). The presence, absence, or quantity of the $Ca^{2+}$ may be important for proper function of the PCDH15. Linkers between the EC domains of PCDH15 have been previously described (e.g., Sotomayor et al, A partial calcium-free linker confers flexibility to inner-ear protocadherin-15, Structure. 2017 Mar. 7; 25(3): 482-495.) Due to the deletion of certain EC domains in mini-PCDH15, some EC domains are connected artificially, and the succeeding EC domain is connected to the preceding one with a linker different from a full-length PCDH15. For example, in mini-PCDH15 V1, EC3 is connected with EC5, and the linker sequence is the last five amino acids of EC3 (DENNQ), as opposed to the situation in a full-length PCDH15, where EC5 is connected to EC4 with the last five amino acids of EC4 (DANDN).

In some embodiments, when connecting two EC domains that are not connected in a wild type PCDH15 (e.g., EC3 connected to EC5 in mini-PCDH15 V1 and V5, EC4 connected to EC8 in mini-PCDH15 V2, EC3 connected to EC8 in mini-PCDH15 V3, EC7 connected to EC11 in mini-PCDH15 V5 and V8, EC4 connected to EC7 in mini-PCDH15 V6 and V8, EC8 connected to EC11 in mini-PCDH15 V6 and V7, EC3 connected to EC9 in mini-PCDH15 V4, EC3 connected to EC7 in mini-PCDH15 V7, EC3 connected to EC11 in mini-PCDH15 V9, and EC2 connected to EC11 in mini-PCDH15 V10), the linking region may or may not affect the function of the miniPCDH15. One skilled in the art would understand that any of the EC domains of PCDH15 may be artificially connected to another EC domain in engineering of the mini-PCDH15.

Non-limiting examples of linkers between the EC domains artificially connected in the mini-PCDH15 are shown in the Table 2 below:

```
                                        (SEQ ID NO: 122)
1. EC3-EC5 (V1, V5); native linker on EC3 (DENNQ (SEQ ID NO: 121)) is used vs EC4's DANDN;

(SEQ ID NO: 124)
2. EC6-EC9 (V1); native linker on EC6 (DVNDN (SEQ

ID NO: 123)) is used vs EC8's DMNDY;

(SEQ ID NO: 125)
3. EC4-EC8 (V2); native linker on EC4 (DANDN (SEQ

ID NO: 122)) is used vs EC7's DIDDN;

(SEQ ID NO: 125)
4. EC3-EC8 (V3); native linker on EC3 (DENNQ (SEQ

ID NO: 121)) is used vs EC7's DIDDN;

(SEQ ID NO: 124)
5. EC3-EC9 (V4); native linker on EC3 (DENNQ (SEQ

ID NO: 121)) is used vs EC8's DMNDY;
```

-continued

```
                                    (SEQ ID NO: 126)
6. EC7-EC11 (V5, V8); native linker on EC7 (DIDDN (SEQ ID NO: 125)) is used vs EC10's DENNH;

(SEQ ID NO: 123)
7. EC4-EC7 (V6, V8); native linker on EC4 (DANDN (SEQ ID NO: 122)) is used vs EC6's DVNDN;

(SEQ ID NO: 126)
8. EC8-EC11 (V6, V7); native linker on EC8 (DMNDY (SEQ ID NO: 124)) is used vs EC10's DENNH;

(SEQ ID NO: 126)
9. EC3-EC11 (V9); native linker on EC3 (DENNQ (SEQ ID NO: 121)) is used vs EC10's DENNH;

(SEQ ID NO: 126)
10. EC2-EC11 (V10); native linker on EC2 (DGDDL (SEQ ID NO: 127)) is used vs EC10's DENNH;

(SEQ ID NO: 123)
11. EC3-EC7 (V7); native linker on EC3 (DENNQ(SEQ

ID NO: 121)) is used vs EC6's DVNDN
```

In some embodiments, in mini-PCDH15 V1, the linker between EC3 and EC5 is the last five amino acids of EC3 (DENNQ (SEQ ID NO: 121)), and/or the linker between EC6 and EC9 is the last five amino acids of EC6 (DVNDN (SEQ ID NO: 123)). In some embodiment, in mini-PCDH15 V2, the linker between EC4 and EC8 is the last five amino acids of EC4 (DANDN (SEQ ID NO: 122)). In some embodiment, in mini-PCDH15 V3, the linker between EC3 and EC8 is the last five amino acids of EC3 (DENNQ (SEQ ID NO: 121)). In some embodiment, in mini-PCDH15 V5, the linker between EC3 and EC5 is the last five amino acids of EC3 (DENNQ (SEQ ID NO: 121)), and/or the linker between EC7 and EC11 is the last five amino acids of EC7 (DIDDN (SEQ ID NO: 125)). In some embodiment, in mini-PCDH15 V6, the linker between EC4 and EC7 is the last five amino acids of EC4 (DANDN (SEQ ID NO: 122)), and/or the linker between EC8 and EC11 is the last five amino acids of EC8 (DMNDY (SEQ ID NO: 124)). In some embodiment, in mini-PCDH15 V4, the linker between EC3 and EC9 is the last five amino acids of EC3 (DENNQ (SEQ ID NO: 121)). In some embodiment, in mini-PCDH15 V7, the linker between EC3 and EC7 is the last five amino acids of EC3 (DENNQ (SEQ ID NO: 121)), and/or the linker between EC8 and EC11 is the last five amino acids of EC8 (DMNDY (SEQ ID NO: 124)). In some embodiment, in mini-PCDH15 V8, the linker between EC4 and EC7 is the last five amino acids of EC4 (DANDN (SEQ ID NO: 122)), and/or the linker between EC7 and EC11 is the last five amino acids of EC7 (DIDDN (SEQ ID NO: 125)). In some embodiment, in mini-PCDH15 V9, the linker between EC3 and EC11 is the last five amino acids of EC3 (DENNQ (SEQ ID NO: 121)). In some embodiment, in mini-PCDH15 V10, the linker between EC2 and EC11 is the last five amino acids of EC2 (DGDDL (SEQ ID NO: 127)).

In some embodiments, these linkers between the EC domains can be further modified to confer desired effect with respect to the function of the mini-PCDH15. In some embodiments, the linkers can be altered to alter its flexibility. In some embodiments, the linkers can be altered to confer calcium binding capacities. In some embodiments, some of the amino acid residues of the linkers can be replaced by amino acids S, A, G, or N, or amino acids S, A, G, or N can be added to the linker sequence to alter flexibility. In some embodiments, a chimeric linker may be formed (e.g., to link EC3 and EC5, a chimeric linker between EC3 linker and EC4 linker can be engineered). In some embodiments, any of the mini-PCDH15 described herein may have altered linker sequence replacing the current linker sequences connecting the EC domains. Non-limiting examples of possible linkers between the artificially connected domains are shown in Table 3 below. It is known in the art that the second amino acid is not conserved and may not be crucial to linker function, therefore the second amino acid residual of the linker are shown as X, which can be any amino acid (e.g., R, G, E, A, P, V, I, M, P, E, V, or Q).

| SEQ ID NO: | EC | | Linker | | | EC | V# Version? |
|---|---|---|---|---|---|---|---|
| 130 | | D | X | N | D | N | |

1. EC3-EC5 (V1, V5); native linker on EC3 (DENNQ (SEQ ID NO: 121)) is used vs EC4's DANDN (SEQ ID NO: 122);

| SEQ ID NO: | EC | | Linker | | | EC | V# Version? |
|---|---|---|---|---|---|---|---|
| 121 | EC3 | D | E | N | N | Q | EC5 | V1, V5 |
| 128 | | D | X | N | N | Q | | |
| 129 | | D | X | N | N | Q | | |
| 130 | | D | X | N | D | N | | |
| 122 | | D | A | N | D | N | | |

2. EC6-EC9 (V1); native linker on EC6 (DVNDN (SEQ ID NO: 123)) is used vs EC8's DMNDY (SEQ ID NO: 124);

| SEQ ID NO: | EC | | Linker | | | EC | V# Version? |
|---|---|---|---|---|---|---|---|
| 123 | EC6 | D | V | N | D | N | EC9 | V1 |
| 131 | | D | X | N | D | Y | | |
| 130 | | D | X | N | D | N | | |
| 124 | | D | M | N | D | Y | | |

3. EC4-EC8 (V2); native linker on EC4 (DANDN (SEQ ID NO: 122)) is used vs EC7's DIDDN (SEQ ID NO: 125);

| SEQ ID NO: | EC | | Linker | | | EC | V# Version? |
|---|---|---|---|---|---|---|---|
| 122 | EC4 | D | A | N | D | N | EC8 | V2 |
| 132 | | D | X | D | D | N | | |
| 125 | | D | I | D | D | N | | |

4. EC3-EC8 (V3); native linker on EC3 (DENNQ (SEQ ID NO: 121)) is used vs EC7's DIDDN (SEQ ID NO: 125);

| SEQ ID NO: | EC | | Linker | | | EC | V# Version? |
|---|---|---|---|---|---|---|---|
| 121 | EC3 | D | E | N | N | Q | EC8 | V3 |
| 129 | | D | X | N | N | Q | | |
| 130 | | D | X | N | D | N | | |
| 133 | | D | X | N | N | N | | |
| 128 | | D | X | N | D | Q | | |
| 125 | | D | I | D | D | N | | |

5. EC3-EC9 (V4); native linker on EC3 (DENNQ (SEQ ID NO: 121)) is used vs EC8's DMNDY (SEQ ID NO: 124);

| SEQ ID NO: | EC | | Linker | | | EC | V# Version? |
|---|---|---|---|---|---|---|---|
| 121 | EC3 | D | E | N | N | Q | EC9 | V4 |
| 128 | | D | X | N | D | Q | | |
| 130 | | D | X | N | D | N | | |
| 131 | | D | X | N | D | Y | | |
| 124 | | D | M | N | D | Y | | |

6. EC7-EC11 (V5, V8); native linker on EC7 (DIDDN (SEQ ID NO: 125)) is used vs EC10's DENNH (SEQ ID NO: 126);

| SEQ ID NO: | EC | | Linker | | | EC | V# Version? |
|---|---|---|---|---|---|---|---|
| 125 | EC7 | D | I | D | D | N | EC11 | V5, V8 |
| 130 | | D | X | N | D | N | | |
| 133 | | D | X | N | N | N | | |

-continued

| SEQ ID NO: | EC | | | Linker | | | EC | V# Version? |
|---|---|---|---|---|---|---|---|---|
| 134 | | D | X | N | N | H | | |
| 135 | | D | X | D | N | H | | |
| 126 | | D | E | N | N | H | | |

7. EC4-EC7 (V6, V8); native linker on EC4
(DANDN (SEQ ID NO: 122)) is used vs EC6's
DVNDN (SEQ ID NO: 123);

| 122 | EC4 | D | A | N | D | N | EC7 | V6, V8 |
|---|---|---|---|---|---|---|---|---|
| 130 | | D | X | N | D | N | | |
| 123 | | D | V | N | D | N | | |

8. EC8-EC11 (V6, V7); native linker on EC8
(DMNDY (SEQ ID NO: 124)) is used vs EC10's
DENNH (SEQ ID NO: 126);

| 124 | EC8 | D | M | N | D | Y | EC11 | V6, V7 |
|---|---|---|---|---|---|---|---|---|
| 130 | | D | X | N | D | N | | |
| 136 | | D | X | N | N | Y | | |
| 133 | | D | X | N | N | N | | |
| 134 | | D | X | N | N | H | | |
| 131 | | D | X | N | D | Y | | |
| 126 | | D | E | N | N | H | | |

9. EC3-EC11 (V9); native linker on EC3
(DENNQ (SEQ ID NO: 121)) is used vs EC10's
DENNH (SEQ ID NO: 126);

| 121 | EC3 | D | E | N | N | Q | EC11 | V9 |
|---|---|---|---|---|---|---|---|---|
| 126 | | D | E | N | N | H | | |

10. EC2-EC11 (V10); native linker on EC2
(DGDDL (SEQ ID NO: 127)) is used vs EC10's
DENNH (SEQ ID NO: 126);

| 127 | EC2 | D | G | D | D | L | EC11 | V10 |
|---|---|---|---|---|---|---|---|---|
| 130 | | D | X | N | D | N | | |
| 133 | | D | X | N | N | N | | |
| 137 | | D | X | N | N | L | | |
| 138 | | D | X | N | D | L | | |
| 126 | | D | E | N | N | H | | |

11. EC3-EC7 (V7); native linker on EC3
(DENNQ(SEQ ID NO: 121)) is used vs EC6's
DVNDN (SEQ ID NO: 123)

| 121 | EC3 | D | E | N | N | Q | EC7 | V7 |
|---|---|---|---|---|---|---|---|---|
| 130 | | D | X | N | D | N | | |
| 133 | | D | X | N | N | N | | |
| 128 | | D | X | N | D | Q | | |
| 123 | | D | V | N | D | N | | |

In some embodiments, any of the known linkers can be used in connecting the EC domains of a miniPCDH15. Non-limiting examples of known linkers include: GGGSGGG (SEQ ID NO: 139), GGSGG (SEQ ID NO: 140), DGNDN (SEQ ID NO: 141), DGNNN (SEQ ID NO: 142), DANDN (SEQ ID NO: 122), DANNN(SEQ ID NO: 143), GGNDN(SEQ ID NO: 144), GGNNN(SEQ ID NO: 145), GGSNN(SEQ ID NO: 146), GGSAA (SEQ ID NO: 147), AANDN(SEQ ID NO: 148), AANNN(SEQ ID NO: 149).

In some embodiments, the transgenes encoding a mini-PCDH15 described by the disclosure mediate cell adhesion by binding to CDH23 at its N-terminal. PCDH15 is a component of tip links, which gate mechanotransduction channels. The PCDH15 C-terminal (cytoplasmic domain) can bind to transmembrane channel like 1 (TMC1) and LHFPL Tetraspan Subfamily Member 5 (LHFPL5). Mutations in PCDH15 have been identified to be related to hereditary hearing loss and/or blindness, for example, Usher Syndrome type 1F. Generally, Usher syndrome refers to a condition characterized by partial or total hearing loss and vision loss that worsens over time. The hearing loss is classified as sensorineural, which means that it is caused by abnormalities of the inner ear. The loss of vision is caused by an eye disease called retinitis pigmentosa (RP), which affects the layer of light-sensitive tissue at the back of the eye (the retina). There are three major types of Usher syndrome, designated as types I, II, and III. These types are distinguished by the severity of hearing loss, the presence or absence of balance problems, and the age at which signs and symptoms appear. The types are further divided into sub-types based on their genetic cause. Usher syndrome type 1F is an inherited disease that causes profound hearing loss from birth and impairs vision beginning in adolescence. Usher Syndrome type 1F is caused by mutations in PCDH15 gene encoding PCDH15.

Generally, ITR sequences are about 145 bp in length. Preferably, substantially the entire sequences encoding the ITRs are used in the molecule, although some degree of minor modification of these sequences is permissible. The ability to modify these ITR sequences is within the skill of the art. (See, e.g., texts such as Sambrook et al., *Molecular Cloning. A Laboratory Manual,* 2d ed., Cold Spring Harbor Laboratory, New York (1989); and K. Fisher et al., *J. Virol.,* 70:520 532 (1996)). An example of such a molecule employed in the present invention is a "cis-acting" plasmid containing the transgene, in which the selected transgene sequence and associated regulatory elements are flanked by the 5' and 3' AAV ITR sequences. The AAV ITR sequences may be obtained from any known AAV, including presently identified mammalian AAV types. In some embodiments, the isolated nucleic acid comprises at least one ITR having a serotype selected from AAV1, AAV2, AAV5, AAV6, AAV6.2, AAV7, AAV8, AAV9, AAV10, and AAV11. In some embodiments, the isolated nucleic acid comprises a region (e.g., a first region) encoding an AAV2 ITR. In some embodiments, the isolated nucleic acid comprises a transgene (e.g., mini-PCDH15) flanked by AAV ITRs (e.g., AAV2 ITR)

In some embodiments, the isolated nucleic acid further comprises a region (e.g., a second region, a third region, a fourth region, etc.) comprising a second AAV ITR. In some embodiments, the second AAV ITR has a serotype selected from AAV1, AAV2, AAV5, AAV6, AAV6.2, AAV7, AAV8, AAV9, AAV10, AAV11, and variants thereof. In some embodiments, the second ITR is a mutant ITR that lacks a functional terminal resolution site (TRS). The term "lacking a terminal resolution site" can refer to an AAV ITR that comprises a mutation (e.g., a sense mutation such as a non-synonymous mutation, or missense mutation) that abrogates the function of the terminal resolution site (TRS) of the ITR, or to a truncated AAV ITR that lacks a nucleic acid sequence encoding a functional TRS (e.g., a ΔTRS ITR). Without wishing to be bound by any particular theory, a rAAV vector comprising an ITR lacking a functional TRS produces a self-complementary rAAV vector, for example, as described by McCarthy (2008) *Molecular Therapy* 16(10):1648-1656. Any referenced cited in the present disclosure are incorporated by reference in its entirety.

The isolated nucleic acid as described herein, may be incorporated into a vector. In addition to the major elements identified above for the recombinant AAV vector, the vector also includes conventional control elements which are operably linked with elements of the transgene in a manner that permits its transcription, translation, and/or expression in a cell transfected with the vector or infected with the virus produced by the invention. As used herein, "operably linked" sequences include both expression control sequences that are contiguous with the gene of interest and expression control sequences that act in trans or at a distance to control the gene of interest. Expression control sequences include appropriate transcription initiation, termination, promoter, and enhancer sequences; efficient RNA processing signals such as splicing and polyadenylation (polyA) signals; sequences that stabilize cytoplasmic mRNA; sequences that enhance translation efficiency (i.e., Kozak consensus sequence); sequences that enhance protein stability; and when desired, sequences that enhance secretion of the encoded product. A number of expression control sequences, including promoters which are native, constitutive, inducible and/or tissue-specific, are known in the art and may be utilized. In some embodiments, the transgene comprises a Kozak consensus sequence at the 5' end of the nucleic acid sequence encoding the transgene (e.g., mini-PCDH15).

As used herein, a nucleic acid sequence (e.g., coding sequence) and regulatory sequences are said to be operably linked when they are covalently linked in such a way as to place the expression or transcription of the nucleic acid sequence under the influence or control of the regulatory sequences. If it is desired that the nucleic acid sequences be translated into a functional protein, two DNA sequences are said to be operably linked if induction of a promoter in the 5' regulatory sequences results in the transcription of the coding sequence and if the nature of the linkage between the two DNA sequences does not (1) result in the introduction of a frame-shift mutation, (2) interfere with the ability of the promoter region to direct the transcription of the coding sequences, or (3) interfere with the ability of the corresponding RNA transcript to be translated into a protein. Thus, a promoter region would be operably linked to a nucleic acid sequence if the promoter region were capable of effecting transcription of that DNA sequence such that the resulting transcript might be translated into the desired protein or polypeptide. Similarly two or more coding regions are operably linked when they are linked in such a way that their transcription from a common promoter results in the expression of two or more proteins having been translated in frame. In some embodiments, operably linked coding sequences yield a fusion protein.

A "promoter" refers to a DNA sequence recognized by the synthetic machinery of the cell, or introduced synthetic machinery, required to initiate the specific transcription of a gene. The phrases "operatively positioned," "under control," or "under transcriptional control" means that the promoter is in the correct location and orientation in relation to the nucleic acid to control RNA polymerase initiation and expression of the gene.

Examples of constitutive promoters include, without limitation, the retroviral Rous sarcoma virus (RSV) LTR promoter (optionally with the RSV enhancer), the cytomegalovirus (CMV) promoter (optionally with the CMV enhancer) [see, e.g., Boshart et al., Cell, 41:521-530 (1985)], the SV40 promoter, the dihydrofolate reductase promoter, the β-actin promoter, the phosphoglycerol kinase (PGK) promoter, and the EF1α promoter [Invitrogen]. In some embodiments, a promoter is hybrid cytomegalovirus (CMV) immediate-early/Chicken beta-actin promoter (CAG promoter). In some embodiments, a promoter is a chicken beta-actin (CBA) promoter. In some embodiments, the promoter is a minimal promoter. A minimal promoter is a part of promoter located between −35 to +35 region with respect to transcription start site. It has one or more of 3 conservative sequence i.e. Tata box, initiator region, binding site for RNA polymerase and downstream promoter element. Exemplary minimal promoters can be less than 400, 400, 200, 195, 190, 185, 180 or less nucleotides in length. In some examples, the minimal promoter is a minimal CMV promoter (e.g., CMV584 promoter bp promoter). In other examples, the minimal promoter is a JeT promoter.

An exemplary nucleic acid sequence for CMV584 bp promoter is set forth in SEQ ID NO: 115:

(SEQ ID NO: 115)
GACATTGATTATTGACTAGTTATTAATAGTAATCAATTACGGGGTCATTA

GTTCATAGCCCATATATGGAGTTCCGCGTTACATAACTTACGGTAAATGG

CCCGCCTGGCTGACCGCCCAACGACCCCCGCCCATTGACGTCAATAATGA

CGTATGTTCCCATAGTAACGCCAATAGGGACTTTCCATTGACGTCAATGG

GTGGAGTATTTACGGTAAACTGCCCACTTGGCAGTACATCAAGTGTATCA

TATGCCAAGTACGCCCCCTATTGACGTCAATGACGGTAAATGGCCCGCCT

GGCATTATGCCCAGTACATGACCTTATGGGACTTTCCTACTTGGCAGTAC

ATCTACGTATTAGTCATCGCTATTACCATGGTGATGCGGTTTTGGCAGTA

CATCAATGGGCGTGGATAGCGGTTTGACTCACGGGGATTTCCAAGTCTCC

ACCCCATTGACGTCAATGGGAGTTTGTTTTGGCACCAAAATCAACGGGAC

TTTCCAAAATGTCGTAACAACTCCGCCCCATTGACGCAAATGGGCGGTAG

GCGTGTACGGTGGGAGGTCTATATAAGCAGAGCT

Inducible promoters allow regulation of gene expression and can be regulated by exogenously supplied compounds, environmental factors such as temperature, or the presence of a specific physiological state, e.g., acute phase, a particular differentiation state of the cell, or in replicating cells only. Inducible promoters and inducible systems are available from a variety of commercial sources, including, without limitation, Invitrogen, Clontech and Ariad. Many other systems have been described and can be readily selected by one of skill in the art. Examples of inducible promoters regulated by exogenously supplied promoters include the zinc-inducible sheep metallothionine (MT) promoter, the dexamethasone (Dex)-inducible mouse mammary tumor virus (MMTV) promoter, the T7 polymerase promoter system (WO 98/10088); the ecdysone insect promoter (No et al., Proc. Natl. Acad. Sci. USA, 93:3346-3351 (1996)), the tetracycline-repressible system (Gossen et al., Proc. Natl. Acad. Sci. USA, 89:5547-5551 (1992)), the tetracycline-inducible system (Gossen et al., Science, 268:1766-1769 (1995), see also Harvey et al., Curr. Opin. Chem. Biol., 2:512-518 (1998)), the RU486-inducible system (Wang et al., Nat. Biotech., 15:239-243 (1997) and Wang et al., Gene Ther., 4:432-441 (1997)) and the rapamycin-inducible system (Magari et al., J. Clin. Invest., 100:2865-2872 (1997)). Still other types of inducible promoters which may be useful in this context are those which are regulated by a specific physiological state, e.g., temperature, acute phase, a particular differentiation state of the cell, or in replicating cells only.

In another embodiment, the native promoter for the transgene will be used. The native promoter may be preferred when it is desired that expression of the transgene should mimic the native expression. The native promoter may be used when expression of the transgene must be regulated temporally or developmentally, or in a tissue-specific manner, or in response to specific transcriptional stimuli. In a further embodiment, other native expression control elements, such as enhancer elements, polyadenylation sites or Kozak consensus sequences may also be used to mimic the native expression. In some embodiments, the promoter is a native promoter. In some examples, the promoter can drive the transgene expression (e.g., mini-PCDH15) in the cells of the eye (e.g., rods, cones, horizontal cells, bipolar cells, and muller glias, etc) (Angueyra et al., Leveraging Zebrafish to Study Retinal Degeneration, *Front Cell Dev Biol.* 2018; 6: 110). Non-limiting exemplary native promoters can be a Methyl-CpG Binding Protein 2 (MeCP2) promoter, a Ubiquitin-C (UbiC) promoter, a Bestrophin 1 (Best1) (retina native) promoter, a human red opsin (RedO) promoter, a human rhodopsin kinase (RK) promoter, a mouse cone arrestin (CAR) promoter, a human rhodopsin (Rho) promoter, a UV opsin-specific 1 (opn1sw1) promoter, a UV opsin-specific 2 (opn1sw2) promoter, an Opsin 1, Medium Wave Sensitive 2 (opn1mw2) promoter, an opsin 1, long-wave-sensitive 1 (opn1lw1) promoter, a blue cone specific promoter (sws2), an L-opsin (opn1lw1-cxxc1) promoter, a thyroid hormone receptor β (thrb) promoter, an LIM Homeobox 1a (lhx1a) promoter, a connexin 55.5 (cx55.5) promoter, a metabotropic glutamate receptor 6b (grm6b), a glial fibrillar acidic protein (gfap) promoter, a cone transducin alpha subunit (gnat2)promoter, a connexin 52.7 (cx52.7) promoter, a connexin 52.9 (cx52.9) promoter, a heat shock cognate 70-kd protein,-like (hsp70l) promoter, a yeast transcription activator protein-(GAL4-VP16) promoter, a upstream activation sequence (UAS), a visual system homeobox 1 (vsx1) promoter, or a rhodopsin (zop) promoter.

For nucleic acids encoding proteins, a polyadenylation sequence generally is inserted following the transgene sequences and before the 3' AAV ITR sequence. A rAAV construct useful in the present disclosure may also contain an intron, desirably located between the promoter/enhancer sequence and the transgene. One possible intron sequence is derived from SV-40, and is referred to as the SV-40 T intron sequence. Another vector element that may be used is an internal ribosome entry site (IRES). An IRES sequence is used to produce more than one polypeptide from a single gene transcript. An IRES sequence would be used to produce a protein that contain more than one polypeptide chains. Selection of these and other common vector elements are conventional and many such sequences are available [see, e.g., Sambrook et al., and references cited therein at, for example, pages 3.18 3.26 and 16.17 16.27 and Ausubel et al., Current Protocols in Molecular Biology, John Wiley & Sons, New York, 1989]. In some embodiments, a Foot and Mouth Disease Virus 2A sequence is included in polyprotein; this is a small peptide (approximately 18 amino acids in length) that has been shown to mediate the cleavage of polyproteins (Ryan, M D et al., EMBO, 1994; 4: 928-933; Mattion, N M et al., J Virology, November 1996; p. 8124-8127; Furler, S et al., Gene Therapy, 2001; 8: 864-873; and Halpin, C et al., The Plant Journal, 1999; 4: 453-459). The cleavage activity of the 2A sequence has previously been demonstrated in artificial systems including plasmids and gene therapy vectors (AAV and retroviruses) (Ryan, M D et al., EMBO, 1994; 4: 928-933; Mattion, N M et al., J Virology, November 1996; p. 8124-8127; Furler, S et al., Gene Therapy, 2001; 8: 864-873; and Halpin, C et al., The Plant Journal, 1999; 4: 453-459; de Felipe, P et al., Gene Therapy, 1999; 6: 198-208; de Felipe, P et al., Human Gene Therapy, 2000; 11: 1921-1931; and Klump, H et al., Gene Therapy, 2001; 8: 811-817).

In some embodiments, the regulatory sequences impart tissue-specific gene expression capabilities. In some cases, the tissue-specific regulatory sequences bind tissue-specific transcription factors that induce transcription in a tissue specific manner. Such tissue-specific regulatory sequences (e.g., promoters, enhancers, etc.) are well known in the art. In some embodiments, the tissue-specific promoter is an eye-specific promoter. Examples of eye-specific promoters include but are not limited to a retinoschisin promoter, K12 promoter, a rhodopsin promoter, a rod-specific promoter, a cone-specific promoter, a rhodopsin kinase promoter, a GRK1 promoter, an interphotoreceptor retinoid-binding protein proximal (IRBP) promoter, and an opsin promoter (e.g., a red opsin promoter, a blue opsin promoter, etc.). In some embodiments, the tissue-specific promoter is an inner ear cell-specific promoter. Examples of inner ear cell-specific promoters include but are not limited to Myosin 7 promoter, Myosin 15 promoter, TMC1 promoter.

The present disclosure, provides isolated nucleic acids and/or vectors (e.g., AAV vectors) for expressing a transgene (e.g., mini-PCDH15), such isolated nucleic acids and/or vectors include AAV LTRs (e.g., AAV2 LTRs) and a transgene operably linked to a promoter (e.g., chicken beta actin promoter or a minimal promoter). In addition, the vector can further comprise certain regulatory elements (e.g., enhancers, kozak sequences, Woodchuck Hepatitis Virus (WHP) Posttranscriptional Regulatory Element (WPRE) and poly adenylation sites (e.g., bovine growth hormone polyadenylation (bgh-PolyA) signal)). In some embodiments, the isolated nucleic acids and/or vectors does not comprise a WPRE. In some embodiments, the isolated nucleic acids and/or vectors comprise a WPRE. In some embodiments, the isolated nucleic acids and/or vectors comprise a BGH signal. In some embodiments, the isolated nucleic acids and/or vectors comprise AAV2 ITR flanking CMV584 bp promoter operably linked to a transgene (e.g., mini-PCDH15), no WPRE and BGH poly (A).

II. Recombinant Adeno-Associated Viruses (rAAVs)

In some aspects, the disclosure provides isolated AAVs. As used herein with respect to AAVs, the term "isolated" refers to an AAV that has been artificially produced or obtained. Isolated AAVs may be produced using recombinant methods. Such AAVs are referred to herein as "recombinant AAVs". Recombinant AAVs (rAAVs) preferably have tissue-specific targeting capabilities, such that a nuclease and/or transgene of the rAAV will be delivered specifically to one or more predetermined tissue(s). The AAV capsid is an important element in determining these tissue-specific targeting capabilities. Thus, a rAAV having a capsid appropriate for the tissue being targeted can be selected.

Methods for obtaining recombinant AAVs having a desired capsid protein are well known in the art. (See, for example, US 2003/0138772), the contents of which are incorporated herein by reference in their entirety). Typically the methods involve culturing a host cell which contains a nucleic acid sequence encoding an AAV capsid protein; a functional rep gene; a recombinant AAV vector composed of, AAV inverted terminal repeats (ITRs) and a transgene; and sufficient helper functions to permit packaging of the recombinant AAV vector into the AAV capsid proteins. In some embodiments, capsid proteins are structural proteins encoded by the cap gene of an AAV. AAVs comprise three capsid proteins, virion proteins 1 to 3 (named VP1, VP2 and VP3), all of which are transcribed from a single cap gene via alternative splicing. In some embodiments, the molecular weights of VP1, VP2 and VP3 are respectively about 87 kDa, about 72 kDa, and about 62 kDa. In some embodiments, upon translation, capsid proteins form a spherical 60-mer protein shell around the viral genome. In some embodiments, the functions of the capsid proteins are to protect the viral genome, deliver the genome and interact with the host. In some aspects, capsid proteins deliver the viral genome to a host in a tissue specific manner.

The present disclosure is based on the findings that exemplary AAV serotype capsid is capable of delivering the transgene (e.g., mini-PCDH15) to the ear (e.g., inner hair cells and outer hair cells, spiral ganglion neurons) or the eyes (e.g., photoreceptors). In some embodiments, an AAV capsid protein is of an AAV serotype selected from the group consisting of AAV9.PHP.B, AAV2.7m8, AAV8BP2, exoAAV, Anc80, AAV1, AAV2, AAV3, AAV4, AAV5, AAV6, AAV7, AAV8, AAVrh8, AAV9, AAV10, and AAVrh10. In some embodiments, the capsid protein is AAV2.7m8 or AAV8BP2. AAV2.7m8 is capable of delivering a transgene targeting cochlear hair cells and supporting cells and the retina. AAV8BP2 shows enhanced transduction rate to the retina (Isgrig et al., AAV2.7m8 is a powerful viral vector for inner ear gene therapy, Nature Communications volume 10, Article number: 427 (2019)). In some embodiments, the capsid protein is of AAV serotype 9 (AAV9). In some embodiments, an AAV capsid protein is of a serotype derived from AAV9, for example AAV9.PHP.B. In some embodiments, the AAV capsid protein comprises the sequence at least 60%, 70%, 80%, 85%, 90%, 91%, 92%, 93%, 94%, 95%, 96%, 97%, 98%, 99% or 100% identical to the amino acid sequence set forth in SEQ ID NO: 47. In some embodiments, the AAV capsid is an exoAAV. An exoAAV, refers to an exosome-associated AAV. An exoAAV capsid protein can be selected from the group consisting of AAV1, AAV2, AAV3, AAV4, AAV5, AAV6, AAV7, AAV8, AAVrh8, AAV9, AAV10, AAVrh10, and AAV.PHP.B. In some examples, the exoAAV is exoAAV1 or exoAAV9. In other embodiments, the AAV capsid protein is Anc80. Anc80 is an in silico predicted ancestor of the widely studied AAV serotypes 1, 2, 8, and 9. Anc80 is a highly potent in vivo gene therapy AAV capsid for targeting liver, muscle, and retina. The present disclosure, at least in part, is based on the capability of AAV9.PHP.B, exoAAV1, or Anc80 to deliver the transgene (e.g., mini-PCDH15) to most of cells in the ear (e.g., inner hair cells, outer hair cells) and cells in the eye (e.g., photoreceptors).

An exemplary acid sequence of AAV9.PHP.B is set forth in SEQ ID NO: 47
```
                               (SEQ ID NO: 47)
MAADGYLPDWLEDNLSEGIREWWALKPGAPQPKANQQHQDNARGLVLPGY

KYLGPGNGLDKGEPVNAADAAALEHDKAYDQQLKAGDNPYLKYNHADAEF

QERLKEDTSFGGNLGRAVFQAKKRLLEPLGLVEEAAKTAPGKKRPVEQSP

QEPDSSAGIGKSGAQPAKKRLNFGQTGDTESVPDPQPIGEPPAAPSGVGS

LTMASGGGAPVADNNEGADGVGSSSGNWHCDSQWLGDRVITTSTRTWALP

TYNNHLYKQISNSTSGGSSNDNAYFGYSTPWGYFDFNRFHCHFSPRDWQR

LINNNWGFRPKRLNFKLFNIQVKEVTDNNGVKTIANNLTSTVQVFTDSDY

QLPYVLGSAHEGCLPPFPADVFMIPQYGYLTLNDGSQAVGRSSFYCLEYF

PSQMLRTGNNFQFSYEFENVPFHSSYAHSQSLDRLMNPLIDQYLYYLSRT

INGSGQNQQTLKFSVAGPSNMAVQGRNYIPGPSYRQQRVSTTVTQNNNSE

FAWPGASSWALNGRNSLMNPGPAMASHKEGEDRFFPLSGSLIFGKQGTGR

DNVDADKVMITNEEEIKTTNPVATESYGQVATNHQSAQTLAVPFKAQAQT
```

-continued
```
GWVQNQGILPGMVWQDRDVYLQGPIWAKIPHTDGNFHPSPLMGGFGMKHP

PPQILIKNTPVPADPPTAFNKDKLNSFITQYSTGQVSVEIEWELQKENSK

RWNPEIQYTSNYYKSNNVEFAVNTEGVYSEPRPIGTRYLTRNL
```

The nucleic acid sequence encoding the AAV9.PHP.B is set forth in SEQ ID NO: 48.
```
                               (SEQ ID NO: 48)
ATGGCTGCCGATGGTTATCTTCCAGATTGGCTCGAGGACAACCTTAGTGA

AGGAATTCGCGAGTGGTGGGCTTTGAAACCTGGAGCCCCTCAACCCAAGG

CAAATCAACAACATCAAGACAACGCTCGAGGTCTTGTGCTTCCGGGTTAC

AAATACCTTGGACCCGGCAACGGACTCGACAAGGGGGAGCCGGTCAACGC

AGCAGACGCGGCGGCCCTCGAGCACGACAAGGCCTACGACCAGCAGCTCA

AGGCCGGAGACAACCCGTACCTCAAGTACAACCACGCCGACGCCGAGTTC

CAGGAGCGGCTCAAAGAAGATACGTCTTTTGGGGGCAACCTCGGGCGAGC

AGTCTTCCAGGCCAAAAAGAGGCTTCTTGAACCTCTTGGTCTGGTTGAGG

AAGCGGCTAAGACGGCTCCTGGAAAGAAGAGGCCTGTAGAGCAGTCTCCT

CAGGAACCGGACTCCTCCGCGGGTATTGGCAAATCGGGTGCACAGCCCGC

TAAAAAGAGACTCAATTTCGGTCAGACTGGCGACACAGAGTCAGTCCCAG

ACCCTCAACCAATCGGAGAACCTCCCGCAGCCCCCTCAGGTGTGGGATCT

CTTACAATGGCTTCAGGTGGTGGCGCACCAGTGGCAGACAATAACGAAGG

TGCCGATGGAGTGGGTAGTTCCTCGGGAAATTGGCATTGCGATTCCCAAT

GGCTGGGGGACAGAGTCATCACCACCAGCACCCGAACCTGGGCCCTGCCC

ACCTACAACAATCACCTCTACAAGCAAATCTCCAACAGCACATCTGGAGG

ATCTTCAAATGACAACGCCTACTTCGGCTACAGCACCCCCTGGGGGTATT

TTGACTTCAACAGATTCCACTGCCACTTCTCACCACGTGACTGGCAGCGA

CTCATCAACAACAACTGGGGATTCCGGCCTAAGCGACTCAACTTCAAGCT

CTTCAACATTCAGGTCAAAGAGGTTACGGACAACAATGGAGTCAAGACCA

TCGCCAATAACCTTACCAGCACGGTCCAGGTCTTCACGGACTCAGACTAT

CAGCTCCCGTACGTGCTCGGGTCGGCTCACGAGGGCTGCCTCCCGCCGTT

CCCAGCGGACGTTTTCATGATTCCTCAGTACGGGTATCTGACGCTTAATG

ATGGAAGCCAGGCCGTGGGTCGTTCGTCCTTTTACTGCCTGGAATATTTC

CCGTCGCAAATGCTAAGAACGGGTAACAACTTCCAGTTCAGCTACGAGTT

TGAGAACGTACCTTTCCATAGCAGCTACGCTCACAGCCAAAGCCTGGACC

GACTAATGAATCCACTCATCGACCAATACTTGTACTATCTCTCAAGAACT

ATTAACGGTTCTGGACAGAATCAACAAACGCTAAAATTCAGTGTGGCCGG

ACCCAGCAACATGGCTGTCCAGGGAAGAAACTACATACCTGGACCCAGCT

ACCGACAACAACGTGTCTCAACCACTGTGACTCAAAACAACAACAGCGAA

TTTGCTTGGCCTGGAGCTTCTTCTTGGGCTCTCAATGGACGTAATAGCTT

GATGAATCCTGGACCTGCTATGGCCAGCCACAAAGAAGGAGAGGACCGTT

TCTTTCCTTTGTCTGGATCTTTAATTTTTGGCAAACAAGGAACTGGAAGA

GACAACGTGGATGCGGACAAAGTCATGATAACCAACGAAGAAGAAATTAA

AACTACTAACCCGGTAGCAACGGAGTCCTATGGACAAGTGGCCACAAACC

ACCAGAGTGCCCAAACTTTGGCGGTGCCTTTTAAGGCACAGGCGCAGACC
```

-continued

GGCTGGGTTCAAAACCAAGGAATACTTCCGGGTATGGTTTGGCAGGACAG

AGATGTGTACCTGCAAGGACCCATTTGGGCCAAAATTCCTCACACGGACG

GCAACTTTCACCCTTCTCCGCTGATGGGAGGGTTTGGAATGAAGCACCCG

CCTCCTCAGATCCTCATCAAAAACACACCTGTACCTGCGGATCCTCCAAC

GGCCTTCAACAAGGACAAGCTGAACTCTTTCATCACCCAGTATTCTACTG

GCCAAGTCAGCGTGGAGATCGAGTGGGAGCTGCAGAAGGAAAACAGCAAG

CGCTGGAACCCGGAGATCCAGTACACTTCCAACTATTACAAGTCTAATAA

TGTTGAATTTGCTGTTAATACTGAAGGTGTATATAGTGAACCCCGCCCCA

TTGGCACCAGATACCTGACTCGTAATCTGTAA

The skilled artisan will also realize that conservative amino acid substitutions may be made to provide functionally equivalent variants, or homologs of the capsid proteins. In some aspects the disclosure embraces sequence alterations that result in conservative amino acid substitutions. As used herein, a conservative amino acid substitution refers to an amino acid substitution that does not alter the relative charge or size characteristics of the protein in which the amino acid substitution is made. Variants can be prepared according to methods for altering polypeptide sequence known to one of ordinary skill in the art such as are found in references that compile such methods, e.g., *Molecular Cloning: A Laboratory Manual*, J. Sambrook, et al., eds., Second Edition, Cold Spring Harbor Laboratory Press, Cold Spring Harbor, New York, 1989, or *Current Protocols in Molecular Biology*, F. M. Ausubel, et al., eds., John Wiley & Sons, Inc., New York. Conservative substitutions of amino acids include substitutions made among amino acids within the following groups: (a) M, I, L, V; (b) F, Y, W; (c) K, R, H; (d) A, G; (e) S, T; (f) Q, N; and (g) E, D. Therefore, one can make conservative amino acid substitutions to the amino acid sequence of the proteins and polypeptides disclosed herein.

In some embodiments, the rAAV is a single stranded AAV (ssAAV). An ssAAV, as used herein, refers to a rAAV with the coding sequence and complementary sequence of the transgene expression cassette on separate strands and are packaged in separate viral capsids. In some embodiments, the rAAV is a self-complementary AAV (scAAV). A scAAV, as used herein, refers to an rAAV with both the coding and complementary sequence of the transgene expression cassette are present on each plus- and minus-strand genome. The coding region of a scAAV was designed to form an intra-molecular double-stranded DNA template. Upon infection, rather than waiting for cell mediated synthesis of the second strand, the two complementary halves of scAAV will associate to form one double stranded DNA (dsDNA) unit that is ready for immediate replication and transcription.

In some embodiments, the rAAV as provided herein, is capable of delivering the transgene (e.g., mini-PCDH15) to a mammal. In some examples, the mammal can be a human or a non-human mammal, such as a mouse, a rat, or a non-human primate (e.g., cynomolgus monkey).

In some embodiments, the rAAV, as provided herein, is capable of delivering the transgene (e.g., mini-PCDH15) to the ear. In some instances, the rAAV as provided herein, is capable of delivering the transgene (e.g., mini-PCDH15) to the cells in the inner ear (e.g., cochlea). In other embodiments, the cells can be cells of the eye. In some examples, the cells can be photoreceptors. Non limiting examples of the target cells are outer hair cells (OHC), inner hair cells (IHC), spiral ganglion neurons, stria vascularis, inner sulcus, spiral ligament, or vestibular system, photoreceptor cells, and other cells in the retina to reinstate the normal pattern or Pcdh15 expression within the photoreceptor inner and outer segments (IS), the outer plexiform layer (OPL), the inner nuclei layer (INL), the ganglion cell layer (GCL), the inner plexiform layer (IPL), and the retinal pigment epithelium (RPE).

The components to be cultured in the host cell to package a rAAV vector in an AAV capsid may be provided to the host cell in trans. Alternatively, any one or more of the required components (e.g., recombinant AAV vector, rep sequences, cap sequences, and/or helper functions) may be provided by a stable host cell which has been engineered to contain one or more of the required components using methods known to those of skill in the art. Most suitably, such a stable host cell will contain the required component(s) under the control of an inducible promoter. However, the required component (s) may be under the control of a constitutive promoter. Examples of suitable inducible and constitutive promoters are provided herein, in the discussion of regulatory elements suitable for use with the transgene. In still another alternative, a selected stable host cell may contain selected component(s) under the control of a constitutive promoter and other selected component(s) under the control of one or more inducible promoters. For example, a stable host cell may be generated which is derived from 293 cells (which contain E1 helper functions under the control of a constitutive promoter), but which contain the rep and/or cap proteins under the control of inducible promoters. Still other stable host cells may be generated by one of skill in the art.

In some embodiments, the instant disclosure relates to a host cell containing a nucleic acid that comprises a coding sequence encoding a protein (e.g., mini-PCDH15). In some embodiments, the host cell is a mammalian cell (e.g., a human cell), a yeast cell, a bacterial cell, an insect cell, a plant cell, or a fungal cell.

The recombinant AAV vector, rep sequences, cap sequences, and helper functions required for producing the rAAV of the disclosure may be delivered to the packaging host cell using any appropriate genetic element (vector). The selected genetic element may be delivered by any suitable method, including those described herein. The methods used to construct any embodiment of this disclosure are known to those with skill in nucleic acid manipulation and include genetic engineering, recombinant engineering, and synthetic techniques. See, e.g., Sambrook et al., *Molecular Cloning: A Laboratory Manual*, Cold Spring Harbor Press, Cold Spring Harbor, N.Y. Similarly, methods of generating rAAV virions are well known and the selection of a suitable method is not a limitation on the present disclosure. See, e.g., K. Fisher et al., *J. Virol.*, 70:520-532 (1993) and U.S. Pat. No. 5,478,745.

In some embodiments, recombinant AAVs may be produced using the triple transfection method (described in detail in U.S. Pat. No. 6,001,650). Typically, the recombinant AAVs are produced by transfecting a host cell with a recombinant AAV vector (comprising a transgene) to be packaged into AAV particles, an AAV helper function vector, and an accessory function vector. An AAV helper function vector encodes the "AAV helper function" sequences (e.g., rep and cap), which function in trans for productive AAV replication and encapsidation. Preferably, the AAV helper function vector supports efficient AAV vector production without generating any detectable wild-type AAV virions (e.g., AAV virions containing functional rep and cap genes).

Non-limiting examples of vectors suitable for use with the present disclosure include pHLP19, described in U.S. Pat. No. 6,001,650 and pRep6cap6 vector, described in U.S. Pat. No. 6,156,303, the entirety of both incorporated by reference herein. The accessory function vector encodes nucleotide sequences for non-AAV derived viral and/or cellular functions upon which AAV is dependent for replication (i.e., "accessory functions"). The accessory functions include those functions required for AAV replication, including, without limitation, those moieties involved in activation of AAV gene transcription, stage specific AAV mRNA splicing, AAV DNA replication, synthesis of cap expression products, and AAV capsid assembly. Viral-based accessory functions can be derived from any of the known helper viruses, such as adenovirus, herpesvirus (other than herpes simplex virus type-1), and vaccinia virus.

In some aspects, the disclosure provides transfected host cells. The term "transfection" is used to refer to the uptake of foreign DNA by a cell, and a cell has been "transfected" when exogenous DNA has been introduced inside the cell membrane. A number of transfection techniques are generally known in the art. See, e.g., Graham et al. (1973) Virology, 52:456, Sambrook et al. (1989) Molecular Cloning, a laboratory manual, Cold Spring Harbor Laboratories, New York, Davis et al. (1986) Basic Methods in Molecular Biology, Elsevier, and Chu et al. (1981) Gene 13:197. Such techniques can be used to introduce one or more exogenous nucleic acids, such as a nucleotide integration vector and other nucleic acid molecules, into suitable host cells.

A "host cell" refers to any cell that harbors, or is capable of harboring, a substance of interest. Often a host cell is a mammalian cell. A host cell may be used as a recipient of an AAV helper construct, an AAV plasmid, an accessory function vector, or other transfer DNA associated with the production of recombinant AAVs. The term includes the progeny of the original cell which has been transfected. Thus, a "host cell" as used herein may refer to a cell which has been transfected with an exogenous DNA sequence. It is understood that the progeny of a single parental cell may not necessarily be completely identical in morphology or in genomic or total DNA complement as the original parent, due to natural, accidental, or deliberate mutation.

As used herein, the term "cell line" refers to a population of cells capable of continuous or prolonged growth and division in vitro. Often, cell lines are clonal populations derived from a single progenitor cell. It is further known in the art that spontaneous or induced changes can occur in karyotype during storage or transfer of such clonal populations. Therefore, cells derived from the cell line referred to may not be precisely identical to the ancestral cells or cultures, and the cell line referred to includes such variants.

As used herein, the terms "recombinant cell" refers to a cell into which an exogenous DNA segment, such as DNA segment that leads to the transcription of a biologically-active polypeptide or production of a biologically active nucleic acid such as an RNA, has been introduced.

As used herein, the term "vector" includes any genetic element, such as a plasmid, phage, transposon, cosmid, chromosome, artificial chromosome, virus, virion, etc., which is capable of replication when associated with the proper control elements and which can transfer gene sequences between cells. Thus, the term includes cloning and expression vehicles, as well as viral vectors. In some embodiments, useful vectors are contemplated to be those vectors in which the nucleic acid segment to be transcribed is positioned under the transcriptional control of a promoter. A "promoter" refers to a DNA sequence recognized by the synthetic machinery of the cell, or introduced synthetic machinery, required to initiate the specific transcription of a gene. The phrases "operatively positioned," "under control" or "under transcriptional control" means that the promoter is in the correct location and orientation in relation to the nucleic acid to control RNA polymerase initiation and expression of the gene. The term "expression vector or construct" means any type of genetic construct containing a nucleic acid in which part or all of the nucleic acid encoding sequence is capable of being transcribed. In some embodiments, expression includes transcription of the nucleic acid, for example, to generate a biologically-active polypeptide product or functional RNA (e.g., guide RNA) from a transcribed gene.

The foregoing methods for packaging recombinant vectors in desired AAV capsids to produce the rAAVs of the disclosure are not meant to be limiting and other suitable methods will be apparent to the skilled artisan.

The present disclosure, provides a rAAV (e.g., scAAV or ssAAV) comprising a vector (e.g., AAV vectors) for expressing a transgene (e.g., mini-PCDH15), such vectors include AAV LTRs (e.g., AAV2 LTRs) and a transgene operably linked to a promoter (e.g., chicken beta actin promoter). In addition, the vector can further comprise certain regulatory elements (e.g., enhancers, kozak sequences, and poly adenylation sites). In addition, the rAAV can comprise a capsid protein (e.g., AAV9.PHP.B capsid). Such rAAV can deliver transgenes (e.g., mini-PCDH15) to target tissues (e.g., ear or eyes). In some embodiments, such rAAV is capable of delivering transgenes (e.g., mini-PCDH15) into specific cells in the target tissue, for example, inner hair cell, out hair cell, or photoreceptors of the eye, etc.

III. Pharmaceutical Composition for Delivering Transgenes to the Ear

The rAAVs may be delivered to a subject in compositions according to any appropriate methods known in the art. The rAAV, preferably suspended in a physiologically compatible carrier (i.e., in a composition), may be administered to a subject, i.e. host animal. In some embodiments, the host animal is a mammal. In some examples, the mammal is a human. In other embodiments, the mammal can be a non-human mammal, such as a human, mouse, rat, cat, dog, sheep, rabbit, horse, cow, goat, pig, guinea pig, hamster, chicken, turkey, or a non-human primate (e.g., cynomolgus monkey).

Delivery of the rAAVs to a mammalian subject may be by, for example, injection to the ear or the eye. In some embodiments, the injection is to the ear through round window membrane of the inner ear or topical administration (e.g., ear drops). In some embodiments, the injection is the eye (e.g., intravitreal or subretinal injection) or topical administration (e.g., eye drops). In some embodiments, the injection is not topical administration. Combinations of administration methods (e.g., topical administration and injection through round window membrane of the inner ear) can also be used.

The compositions of the disclosure may comprise a rAAV alone, or in combination with one or more other viruses (e.g., a second rAAV encoding having one or more different transgenes). In some embodiments, a composition comprises 1, 2, 3, 4, 5, 6, 7, 8, 9, 10, or more different rAAVs each having one or more different transgenes.

In some embodiments, a composition further comprises a pharmaceutically acceptable carrier. Suitable carriers may be readily selected by one of skill in the art in view of the indication for which the rAAV is directed. "Acceptable" means that the carrier must be compatible with the active ingredient of the composition (and preferably, capable of stabilizing the active ingredient) and not deleterious to the subject to be treated. Pharmaceutically acceptable excipients (carriers) including buffers, which are well known in the art. See, e.g., Remington: *The Science and Practice of Pharmacy* 20th Ed. (2000) Lippincott Williams and Wilkins, Ed. K. E. Hoover. For example, one acceptable carrier includes saline, which may be formulated with a variety of buffering solutions (e.g., phosphate buffered saline). Other exemplary carriers include sterile saline, lactose, sucrose, calcium phosphate, gelatin, dextran, agar, pectin, peanut oil, sesame oil, and water. The selection of the carrier is not a limitation of the present disclosure.

The rAAV containing pharmaceutical composition disclosed herein may further comprise a suitable buffer agent. A buffer agent is a weak acid or base used to maintain the pH of a solution near a chosen value after the addition of another acid or base. In some examples, the buffer agent disclosed herein can be a buffer agent capable of maintaining physiological pH despite changes in carbon dioxide concentration (produced by cellular respiration). Exemplary buffer agents include, but are not limited to, HEPES (4-(2-hydroxyethyl)-1-piperazineethanesulfonic acid) buffer, Dulbecco's phosphate-buffered saline (DPBS) buffer, or Phosphate-buffered Saline (PBS) buffer. Such buffers may comprise disodium hydrogen phosphate and sodium chloride, or potassium dihydrogen phosphate and potassium chloride.

Optionally, the compositions of the disclosure may contain, in addition to the rAAV and carrier(s), other pharmaceutical ingredients, such as preservatives, or chemical stabilizers. Suitable exemplary preservatives include chlorobutanol, potassium sorbate, sorbic acid, sulfur dioxide, propyl gallate, the parabens, ethyl vanillin, glycerin, phenol, and parachlorophenol. Suitable chemical stabilizers include gelatin and albumin.

The rAAV containing pharmaceutical composition described herein comprises one or more suitable surface-active agents, such as a surfactant. Surfactants are compounds that lower the surface tension (or interfacial tension) between two liquids, between a gas and a liquid, or between a liquid and a solid. Surfactants may act as detergents, wetting agents, emulsifiers, foaming agents, and dispersants. Suitable surfactants include, in particular, non-ionic agents, such as polyoxyethylenesorbitans (e.g., Tween™ 20, 40, 60, 80 or 85) and other sorbitans (e.g., Span™ 20, 40, 60, 80 or 85). Compositions with a surface-active agent will conveniently comprise between 0.05 and 5% surface-active agent, and can be between 0.1 and 2.5%. It will be appreciated that other ingredients may be added, for example mannitol or other pharmaceutically acceptable vehicles, if necessary.

The rAAVs are administered in sufficient amounts to transfect the cells of a desired tissue (e.g., inner hair cells, outer hair cells, or photoreceptors of the eye) and to provide sufficient levels of gene transfer and expression without undue adverse effects. Examples of pharmaceutically acceptable routes of administration include, but are not limited to, direct delivery to the selected organ (e.g., the ear and the eye), oral, inhalation (including intranasal and intratracheal delivery), intraocular, intravenous, intramuscular, subcutaneous, intradermal, intratumoral, and other parental routes of administration. Routes of administration may be combined, if desired.

The dose of rAAV virions required to achieve a particular "therapeutic effect," e.g., the units of dose in viral genome copies/per kilogram of body weight (GC/kg or VG/kg), will vary based on several factors including, but not limited to: the route of rAAV virion administration, the level of gene or RNA expression required to achieve a therapeutic effect, the specific disease or disorder being treated, and the stability of the gene or RNA product. One of skill in the art can readily determine a rAAV virion dose range to treat a patient having a particular disease or disorder based on the aforementioned factors, as well as other factors.

An effective amount of a rAAV is an amount sufficient to target infect an animal (e.g., mouse, rat, non-human primate or human), target a desired tissue (e.g., the inner ear or the eye). The effective amount will depend primarily on factors such as the species, age, weight, health of the subject, and the tissue to be targeted, and may thus vary among animal and tissue. For example, an effective amount of the rAAV is generally in the range of from about 1 ml to about 100 ml of solution containing from about $10^9$ to $10^{16}$ genome copies. In some cases, a dosage between about $10^{11}$ to $10^{13}$ rAAV genome copies is appropriate. In certain embodiments, $10^9$ rAAV genome copies is effective to target inner ear tissue (e.g., inner hair cells, out hair cells or photoreceptors of the eye). In some embodiments, a dose more concentrated than $10^9$ rAAV genome copies is toxic when administered to the eye of a subject. In some embodiments, an effective amount is produced by multiple doses of a rAAV.

In some embodiments, a dose of rAAV is administered to a subject no more than once per calendar day (e.g., a 24-hour period). In some embodiments, a dose of rAAV is administered to a subject no more than once per 2, 3, 4, 5, 6, or 7 calendar days. In some embodiments, a dose of rAAV is administered to a subject no more than once per calendar week (e.g., 7 calendar days). In some embodiments, a dose of rAAV is administered to a subject no more than bi-weekly (e.g., once in a two calendar week period). In some embodiments, a dose of rAAV is administered to a subject no more than once per calendar month (e.g., once in 30 calendar days). In some embodiments, a dose of rAAV is administered to a subject no more than once per six calendar months. In some embodiments, a dose of rAAV is administered to a subject no more than once per calendar year (e.g., 365 days or 366 days in a leap year).

In some embodiments, rAAV compositions are formulated to reduce aggregation of AAV particles in the composition, particularly where high rAAV concentrations are present (e.g., ~$10^{13}$ GC/ml or more). Appropriate methods for reducing aggregation of may be used, including, for example, addition of surfactants, pH adjustment, salt concentration adjustment, etc. (See, e.g., Wright et al., *Molecular Therapy* (2005) 12, 171-178, the contents of which are incorporated herein by reference.)

Formulation of pharmaceutically-acceptable excipients and carrier solutions is well-known to those of skill in the art, as is the development of suitable dosing and treatment regimens for using the particular compositions described herein in a variety of treatment regimens. Typically, these formulations may contain at least about 0.1% of the active compound or more, although the percentage of the active ingredient(s) may, of course, be varied and may conveniently be between about 1 or 2% and about 70% or 80% or more of the weight or volume of the total formulation. Naturally, the amount of active compound in each therapeutically-useful composition may be prepared is such a way that a suitable dosage will be obtained in any given unit dose of the compound. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable.

In some embodiments, rAAVs in suitably formulated pharmaceutical compositions disclosed herein are delivered directly to target tissue, e.g., direct to inner ear tissue (e.g., inner hair cells, outer hair cells or photoreceptors of the eye). In other embodiments, the target tissue can be an eye. The rAAVs in suitably formulated pharmaceutical compositions disclosed herein are delivered directly to the eye (e.g., photoreceptors). However, in certain circumstances it may be desirable to separately or in addition deliver the rAAV-based therapeutic constructs via another route, e.g., subcutaneously, intrapancreatically, intranasally, parenterally, intravenously, intramuscularly, intrathecally, or orally, intraperitoneally, or by inhalation. In some embodiments, the administration modalities as described in U.S. Pat. Nos. 5,543,158; 5,641,515 and 5,399,363 (each specifically incorporated herein by reference in its entirety) may be used to deliver rAAVs.

The pharmaceutical forms suitable for injectable use include sterile aqueous solutions or dispersions and sterile powders for the extemporaneous preparation of sterile injectable solutions or dispersions. Dispersions may also be prepared in glycerol, liquid polyethylene glycols, and mixtures thereof and in oils. Under ordinary conditions of storage and use, these preparations contain a preservative to prevent the growth of microorganisms. In many cases the form is sterile and fluid to the extent that easy syringability exists. It must be stable under the conditions of manufacture and storage and must be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and by the use of surfactants. The prevention of the action of microorganisms can be brought about by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

For administration of an injectable aqueous solution, for example, the solution may be suitably buffered, if necessary, and the liquid diluent first rendered isotonic with sufficient saline or glucose. These particular aqueous solutions are especially suitable for intravenous administration, intramuscular administration, subcutaneous administration, intraperitoneal administration, subretinal administration, intravitreal administration, and injection through round window membrane of the inner ear. In this connection, a suitable sterile aqueous medium may be employed. For example, one dosage may be dissolved in 1 ml of isotonic NaCl solution and either added to 1000 ml of hypodermoclysis fluid or injected at the proposed site of infusion, (see for example, "Remington's Pharmaceutical Sciences" 15th Edition, pages 1035-1038 and 1570-1580). Some variation in dosage will necessarily occur depending on the condition of the host. The person responsible for administration will, in any event, determine the appropriate dose for the individual host.

Sterile injectable solutions are prepared by incorporating the active rAAV in the required amount in the appropriate solvent with various of the other ingredients enumerated herein, as required, followed by filtered sterilization. Generally, dispersions are prepared by incorporating the various sterilized active ingredients into a sterile vehicle which contains the basic dispersion medium and the required other ingredients from those enumerated above. In the case of sterile powders for the preparation of sterile injectable solutions, the preferred methods of preparation are vacuum-drying and freeze-drying techniques which yield a powder of the active ingredient plus any additional desired ingredient from a previously sterile-filtered solution thereof.

The rAAV compositions disclosed herein may also be formulated in a neutral or salt form. Pharmaceutically-acceptable salts, include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as iso-propylamine, trimethylamine, histidine, procaine and the like. Upon formulation, solutions will be administered in a manner compatible with the dosage formulation and in such amount as is therapeutically effective. The formulations are easily administered in a variety of dosage forms such as injectable solutions, drug-release capsules, and the like.

As used herein, "carrier" includes any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Supplementary active ingredients can also be incorporated into the compositions. The phrase "pharmaceutically-acceptable" refers to molecular entities and compositions that do not produce an allergic or similar untoward reaction when administered to a host.

Delivery vehicles such as liposomes, nanocapsules, microparticles, microspheres, lipid particles, vesicles, and the like, may be used for the introduction of the compositions of the present disclosure into suitable host cells. In particular, the rAAV vector delivered transgenes may be formulated for delivery either encapsulated in a lipid particle, a liposome, a vesicle, a nanosphere, or a nanoparticle or the like.

Such formulations may be preferred for the introduction of pharmaceutically acceptable formulations of the nucleic acids or the rAAV constructs disclosed herein. The formation and use of liposomes is generally known to those of skill in the art. Recently, liposomes were developed with improved serum stability and circulation half-times (U.S. Pat. No. 5,741,516). Further, various methods of liposome and liposome like preparations as potential drug carriers have been described (U.S. Pat. Nos. 5,567,434; 5,552,157; 5,565,213; 5,738,868 and 5,795,587).

Liposomes have been used successfully with a number of cell types that are normally resistant to transfection by other procedures. In addition, liposomes are free of the DNA length constraints that are typical of viral-based delivery systems. Liposomes have been used effectively to introduce genes, drugs, radiotherapeutic agents, viruses, transcription factors and allosteric effectors into a variety of cultured cell lines and animals. In addition, several successful clinical trials examining the effectiveness of liposome-mediated drug delivery have been completed.

Liposomes are formed from phospholipids that are dispersed in an aqueous medium and spontaneously form multilamellar concentric bilayer vesicles (also termed multilamellar vesicles (MLVs). MLVs generally have diameters of from 25 nm to 4 µm. Sonication of MLVs results in the formation of small unilamellar vesicles (SUVs) with diameters in the range of 200 to 500 Å, containing an aqueous solution in the core.

Alternatively, nanocapsule formulations of the rAAV may be used. Nanocapsules can generally entrap substances in a stable and reproducible way. To avoid side effects due to intracellular polymeric overloading, such ultrafine particles (sized around 0.1 µm) should be designed using polymers able to be degraded in vivo. Biodegradable polyalkyl-cyanoacrylate nanoparticles that meet these requirements are contemplated for use.

IV. Therapeutic Applications

The present disclosure also provides methods for delivering a transgene (e.g., mini-PCDH15) to the ear or the eye for treating hearing loss and/or blindness (e.g., Usher Syndrome type 1F).

In some embodiments, the subject can be a mammal. In some examples, the subject can be a human. In other embodiments, the subject can be a non-human mammal such as mouse, rat, cow, goat, pig, camel, and non-human primate (e.g., cynomolgus monkey).

In some embodiments, the subject is having or suspected of having hearing loss and/or blindness. In some examples, the subject is diagnosed of having Usher Syndrome type 1F. In further examples, the hearing loss and/or blindness is associated with a mutation in the PCDH15 gene. In some examples, the mutation of PCDH15 gene is a point mutation, a missense mutation, a nonsense mutation, a deletion, an insertion or a combination thereof. Non-limiting exemplary mutations in PCDH15 are shown in Table 1. A mutation, as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* (4th ed., Cold Spring Harbor Laboratory Press, Cold Spring Harbor, N.Y. (2012)).

TABLE 1

| Exemplary mutations in PCDH15 | | |
|---|---|---|
| Accession NO: | Mutation | Amino Acid Change |
| NM_033056.3(PCDH15) | c.400C>G | p.Arg134Gly |
| NM_033056.3(PCDH15) | c.733C>T | p.Arg245Ter |
| NM_033056.3(PCDH15) | c.785G>A | p.Gly262Asp |
| NM_033056.3(PCDH15) | c.1583T>A | p.Val528Asp |
| NM_033056.3(PCDH15) | c.3316C>T | p.Arg1106Ter |
| NM_001142769.2(PCDH15) | c.4726C>T | p.Gln1576Ter |
| NM_033056.3(PCDH15) | c.4035T>A | p.Tyr1345Ter |
| NM_033056.3(PCDH15) | c.1997+1G>A | |
| NM_033056.3(PCDH15) | c.3984–1G>C GRCh38/hg38 10q21.1(chr10: 53954459-54098171)x0 | |
| NM_033056.3(PCDH15) | c.158–1G>A | |
| NM_033056.3(PCDH15) | c.16delT | p.Tyr6Ilefs |
| NM_001142763.1(PCDH15) | c.2986C>T | p.Arg996Ter |
| NM_033056.3(PCDH15) | c.1998–2A>G | |
| NM_033056.3(PCDH15) | c.1927C>T | p.Arg643Ter |
| NM_033056.3(PCDH15) PCDH15, IVS27, A-G, –2 | c.3358C>T ( ) | p.Arg1120Ter |
| NM_033056.3(PCDH15) | c.(?_–15)_(876_?) | del |
| NM_033056.3(PCDH15) | c.706–3_717delCAGGACCGTGCCCAA | |
| NM_033056.3(PCDH15) | c.(?_3374)_(3501_?) | del (p.(?)) |
| NM_033056.3(PCDH15) | c.1940C>G | p.Ser647Ter |
| NM_033056.3(PCDH15) | c.1086delT | p.Leu363Trpfs |
| NM_001142772.1(PCDH15) | c.400C>T | p.Arg134Ter |
| NM_033056.3(PCDH15) | c.2419dupA | p.Ile807Asnfs |
| NM_033056.3(PCDH15) PCDH15, | c.7C>T 3-BP DEL, 5601AAC | p.Arg3Ter |
| NM_033056.3(PCDH15) PCDH15, | c.394dupG 1-BP DEL, 16T | p.Glu132Glyfs |
| NM_001142763.1(PCDH15) | c.(?_–1)_(2235+1_2236–1) | del |
| NM_001142763.1(PCDH15) NC_000010.10 NC_000010.10 | c.5385_5394delTCCTCTTCCT g.56104359_56108448del4090 g.55829578_56723036del893459 | p.Pro1796Leufs |
| NM_033056.3(PCDH15) | c.157+1G>C | |
| NM_033056.3(PCDH15) | c.3885_3889dup | p.Ala1297Glufs |
| NM_033056.3(PCDH15) | c.2825delG | p.Gly942Valfs |
| NM_033056.3(PCDH15) | c.3983+1G>T | |
| NM_033056.3(PCDH15) | c.1770_1771delTC | p.Pro591Cysfs |
| NM_001142763.1 | c.–189197_c.610–5166del | |
| NM_033056.3(PCDH15) | c.416_444del29 ( ) | p.Asp139Alafs |

TABLE 1-continued

| Accession NO: | Mutation | Amino Acid Change |
|---|---|---|
| NM_033056.3(PCDH15) | c.3653delT | p.Phe1218Serfs |
| NM_033056.3(PCDH15) | c.3717+1G>A | |
| NM_033056.3(PCDH15) | c.2624C>A | p.Ser875Ter |
| NM_033056.3(PCDH15) | c.2785C>T ( ) | p.Arg929Ter |
| NM_033056.3(PCDH15) | c.4313delC ( ) | p.Pro1438Argfs |
| NM_033056.3(PCDH15) | c.2487dupA ( ) | p.Glu830Argfs |
| NM_033056.3(PCDH15) | c.4368−2A>T | |
| NM_033056.3(PCDH15) | c.4368−15_4368−2delTTCTTTTCTTTCAA | |
| NM_033056.3(PCDH15) | c.1785−2A>C | |
| NM_033056.3(PCDH15) | c.4227T>A ( ) | p.Cys1409Ter |
| NM_033056.3(PCDH15) | c.594+1G>T | |
| NM_033056.3(PCDH15) | c.1006C>T ( ) | p.Arg336Ter |
| NM_033056.3(PCDH15) | c.1305+1G>A | |
| NM_033056.3(PCDH15) | c.901dupA | p.Thr301Asnfs |
| NM_033056.3(PCDH15) | c.3211delA | p.Ile1071Leufs |
| NM_033056.3(PCDH15) | c.333dupA | p.His112Thrfs |
| NM_033056.3(PCDH15) | c.3341delT | p.Val1114Glyfs |
| NM_033056.3(PCDH15) | c.4367+1G>A | |
| NM_033056.3(PCDH15) | c.1627delG | p.Glu543Argfs |
| NM_033056.3(PCDH15) | c.4197_4198insGTAG | p.Arg1400Valfs |
| NM_033056.3(PCDH15) | c.4211+2dupT | |
| NM_033056.3(PCDH15) | c.1806T>G | p.Tyr602Ter |
| NM_033056.3(PCDH15) | c.3441dupA | p.Phe1148Ilefs |
| NM_033056.3(PCDH15) | c.3082delC | p.His1028Ilefs |
| NM_033056.3(PCDH15) | c.1830_1833delTCAA | p.Asn610Lysfs |
| NM_033056.3(PCDH15) | c.1737C>G | p.Tyr579Ter |
| NM_033056.3(PCDH15) | c.358_359delTG | p.Cys120Hisfs |
| NM_033056.3(PCDH15) | c.3023delC | p.Ala1008Valfs |
| NM_033056.3(PCDH15) | c.1915C>T | p.Gln639Ter |
| NM_033056.3(PCDH15) | c.*12348A>G | |
| NM_033056.3(PCDH15) | c.5435C>T | p.Pro1812Leu |
| NM_001142771.1(PCDH15) | c.4627G>A | p.Gly1543Ser |
| NM_033056.3(PCDH15) | c.2367_2369delTGT | p.Val790del |
| NM_033056.3(PCDH15) | c.1362C>T | p.Val454= |
| NM_033056.3(PCDH15) | c.3502−8C>T | |
| NM_033056.3(PCDH15) | c.330C>T | p.Asn110= |
| NM_033056.3(PCDH15) | c.5601_5603delAAC | p.Thr1869del |
| NM_033056.3(PCDH15) | c.5280_5342del63 | p.Ala1761_Pro1781del |
| NM_033056.3(PCDH15) | c.243G>A | p.Val81= |
| NM_033056.3(PCDH15) | c.5287_5292delGCTCCT | p.Ala1763_Pro1764del |
| NM_033056.3(PCDH15) | c.2885G>T | p.Arg962Leu |
| NM_033056.3(PCDH15) | c.2424G>C | p.Lys808Asn |
| NM_033056.3(PCDH15) | c.3195A>G | p.Gln1065= |
| NM_033056.3(PCDH15) | c.4812G>T ( ) | p.Arg1604Ser |
| NM_033056.3(PCDH15) | c.5353T>C ( ) | p.Ser1785Pro |
| NM_033056.3(PCDH15) | c.5283T>A | p.Ala1761= |
| NM_033056.3(PCDH15) | c.4783A>C | p.Ile1595Leu |
| NM_033056.3(PCDH15) | c.475−3C>T | |
| NM_033056.3(PCDH15) | c.4334C>G | p.Ala1445Gly |
| NM_033056.3(PCDH15) | c.2884C>T | p.Arg962Cys |
| NM_033056.3(PCDH15) | c.3983+12T>C | |
| NM_033056.3(PCDH15) | c.960A>G | p.Pro320= |
| NM_033056.3(PCDH15) | c.546A>G | p.Gly182= |
| NM_033056.3(PCDH15) | c.1910A>G | p.Asn637Ser |
| NM_033056.3(PCDH15) | c.2625G>A | p.Ser875= |
| NM_033056.3(PCDH15) | c.5359C>T | p.Pro1787Ser |
| NM_001142763.1(PCDH15) | c.4871A>G | p.Asn1624Ser |
| NM_033056.3(PCDH15) | c.2563C>T | p.Arg855Trp |
| NM_033056.3(PCDH15) | c.5254_5256delCCT | p.Pro1752del |
| NM_033056.3(PCDH15) | c.3018G>T | p.Val1006= |
| NM_033056.3(PCDH15) | c.4831_4834dupAACA | p.Thr1612Lysfs |
| NM_033056.3(PCDH15) | c.5565C>T | p.Ala1855= |
| NM_033056.3(PCDH15) | c.3795A>T | p.Glu1265Asp |
| NM_033056.3(PCDH15) | c.4080G>A | p.Val1360= |
| NM_033056.3(PCDH15) | c.1360G>A | p.Val45411e |
| NM_033056.3(PCDH15) | c.3936A>G | p.Ala1312= |

Aspects of the present disclosure relates to method of treating hearing loss and/or blindness (e.g., Usher Syndrome type 1F) by delivering a functional gene product (e.g., mini-PCDH15) using gene therapy (e.g., rAAV encoding mini-PCDH15) to a target cells (e.g., inner hair cell, outer hair cell, and photoreceptors), which comprise one or more mutations in both alleles in a relevant gene (e.g., PCDH15) that results in absence or malfunction of the gene product.

Other aspects of the present disclosure relates to method of treating hearing loss and/or blindness (e.g., Usher Syndrome type 1F) by correcting one or more mutations (e.g., point mutations) in a relevant gene (e.g., PCDH15) in a target cell (e.g., inner hair cell, outer hair cell, and photo-receptors) using base editors (e.g., ABEmax). Non-limiting exemplary mutations can be found in Table 1.

(i) Methods for Delivering Functional Mini-PCDH15

Aspects of the invention relate to certain protein-encoding transgenes (e.g., mini-PCDH15) that when delivered to a subject an effective for promoting cell adhesion the inner ear and in the retina of the subject. In some embodiments, the subject has or is suspected of having hearing loss and/or blindness. In some examples, the hearing loss and/or blindness is associated with a mutation of the PCDH15 gene. In one example, the subject is diagnosed with Usher Syndrome, type 1F.

Accordingly, methods and compositions described by the disclosure are useful, in some embodiments, for the treatment of Usher syndrome, Type 1F associated with one or more mutations or deletions of PCDH15 gene, such as hearing loss, deafness, and/or progressive vision loss, and blindness.

Methods for delivering a transgene (e.g., mini-PCDH15) to a subject are provided by the disclosure. The methods typically involve administering to a subject an effective amount of an isolated nucleic acid encoding a mini-PCDH15, or a rAAV comprising a nucleic acid for expressing a mini-PCDH15.

In some embodiments, the hearing loss and/or blindness is Usher syndrome type 1F. Generally, a mutation or mutations in PCDH15 account for Usher syndrome type 1F. In some embodiments, the PCDH15 mutation can be, but are not limited to, point mutations, missense mutations, non-sense mutations, insertions, or deletions. In some examples, the PCDH15 gene mutations associated with Usher syndrome, type 1F include but are not limited to mutations in Table 1 (ClinVar, NCBI). In one example, the mutation in PCDH15 is c.733C>T. Mutations in a PCDH15 gene of a subject (e.g., a subject having or suspected of having Usher Syndrome type 1F associated with a deletion or mutation of PCDH15 gene) may be identified from a sample obtained from the subject (e.g., a DNA sample, RNA sample, blood sample, or other biological sample) by any method known in the art. For example, in some embodiments, a nucleic acid (e.g., DNA, RNA, or a combination thereof) is extracted from a biological samples obtained from a subject and nucleic acid sequencing is performed in order to identify a mutation in the PCDH15 gene. Examples of nucleic acids sequencing techniques include but are not limited to Maxam-Gilbert sequencing, pyrosequencing, chain-termination sequencing, massively parallel signature sequencing, single-molecule sequencing, nanopore sequencing, Illumina sequencing, etc. In some embodiments, a mutation in PCDH15 gene is detected indirectly, for example by quantifying mini-PCDH15 protein expression (e.g., by Western blot) or function (e.g., by analyzing structure, function, etc.), or by direct sequencing of the DNA and comparing the sequence obtained to a control DNA sequence (e.g., a wild-type PCDH15 DNA sequence).

In some aspects, the disclosure provides a method for treating an Usher syndrome type 1F in a subject in need thereof, the method comprising administering to a subject having or is suspected of having Usher syndrome type 1F a therapeutically effective amount of an isolated nucleic acid, or a rAAV encoding a transgene (e.g., mini-PCDH15) through injections to the round window membrane of the inner ear, as described by the disclosure. In other embodiments, the injection is to the eye (e.g., intravitreal injection)

An "effective amount" of a substance is an amount sufficient to produce a desired effect. In some embodiments, an effective amount of an isolated nucleic acid (e.g., an isolated nucleic acid comprising a transgene encoding mini-PCDH15) is an amount sufficient to transfect (or infect in the context of rAAV mediated delivery) a sufficient number of target cells of a target tissue of a subject. In some embodiments, a target tissue is cochlear (e.g., inner hair cells, outer hair cells, etc.). In other embodiments, a target tissue is the eye (e.g., photoreceptors). In some embodiments, an effective amount of an isolated nucleic acid (e.g., which may be delivered via an rAAV) may be an amount sufficient to have a therapeutic benefit in a subject, e.g., to increase or supplement the expression of a gene or protein of interest (e.g., mini-PCDH15), to improve in the subject one or more symptoms of disease (e.g., a symptom of Usher syndrome type 1F), etc. The effective amount will depend on a variety of factors such as, for example, the species, age, weight, health of the subject, and the tissue to be targeted, and may thus vary among subject and tissue as described elsewhere in the disclosure.

In some embodiments, the method is for delivering a transgene to cochlear (e.g., inner hair cells, and outer hair cells) tissue in a subject are provided herein. In other embodiments, the method is for delivering a transgene to the cells in the eye (e.g., photoreceptors). The methods typically involve administering to a subject an effective amount of a rAAV comprising a nucleic acid for expressing a transgene (e.g., mini-PCDH15) in the subject. An "effective amount" of a rAAV is an amount sufficient to infect a sufficient number of cells of a target tissue in a subject. In some embodiments, a target tissue is cochlea (e.g., inner hair cells, outer hair cells) tissue. In other embodiments, the target tissue is the retina (e.g., photoreceptors). An effective amount of a rAAV may be an amount sufficient to have a therapeutic benefit in a subject, e.g., to improve in the subject one or more symptoms of disease, e.g., a symptom of a hereditary hearing loss (e.g., Usher syndrome type 1F). In some cases, an effective amount of a rAAV may be an amount sufficient to produce a stable somatic transgenic animal model. The effective amount will depend on a variety of factors such as, for example, the species, age, weight, health of the subject, and the tissue to be targeted, and may thus vary among subject and tissue.

An effective amount may also depend on the rAAV used. The invention is based, in part on the recognition that rAAV comprising capsid proteins having a particular serotype (e.g., AAV9.PHP.B, exoAAV, and Anc80) mediate more efficient transduction of cochlear (e.g., inner hair cells, out hair cells) tissue that rAAV comprising capsid proteins having a different serotype.

In certain embodiments, the effective amount of rAAV is $10^{10}$, $10^{11}$, $10^{12}$, $10^{13}$, or $10^{14}$ genome copies per kg. In certain embodiments, the effective amount of rAAV is $10^{10}$, $10^{11}$, $10^{12}$, $10^{13}$, $10^{14}$, or $10^{15}$ genome copies per subject.

An effective amount may also depend on the mode of administration. For example, targeting a cochlear (e.g., inner hair cells, and out hair cells) tissue by injection through the round window membrane of the inner ear may require different (e.g., higher or lower) doses, in some cases, than targeting a cochlea (e.g., inner hair cells, out hair cells) tissue by another method (e.g., systemic administration, topical administration). In other cases, targeting the eye (e.g., photoreceptors) by injection behind the eye (e.g., subretinal injection and intravitreal injection) may require different does, in some cases, than targeting the eye (e.g., photoreceptors) by another method (e.g., systemic administration, topical administration). Thus, in some embodiments, the injection is injection through round window membrane of the inner ear. In some embodiments, the administration is via injection, optionally subretinal injection or intravitreal injection. In some embodiments, the injection is topical administration (e.g., topical administration to an ear), or posterior semicircular canal injection. In some cases, multiple doses of a rAAV are administered.

Without wishing to be bound by any particular theory, efficient transduction of cochlear (e.g., inner hair cells, out hair cells, or photoreceptors) cells by rAAV described herein may be useful for the treatment of a subject having a hereditary hearing loss and/or vision loss (e.g., Usher syndrome type 1F). Accordingly, methods and compositions for treating hereditary hearing loss are also provided herein. In some aspects, the disclosure provides a method for treating a hereditary hearing loss and or vision loss (e.g., Usher syndrome type 1F), the method comprising: administering to a subject having or suspected of having an a hereditary hearing loss an effective amount of rAAV, wherein the rAAV comprises (i) a capsid protein having a serotype of AAV9.PHP.B, exoAAV1 or Anc80, and (ii) an isolated nucleic acid comprising a promoter operably linked to a transgene (e.g., a transgene encoding a mini-PCDH15) and AAV LTRs.

In some embodiments, the rAAV (e.g., rAAV encoding mini-PCDH15) can be administered to the patients (e.g., patients with Usher 1F syndrome or hereditary hearing loss) at age of 6 month, 1 year, 2 years, 3 years, 5 years, 6 years, 7 years, 8 years, 9, years, 10 years, 11 years, 12 years, 13 years, 14 years, 15 years, 16 years, 17 years, 18 years or older. In some embodiments, the patient is an infant, a child, or an adult. In some embodiments, the rAAV (e.g., rAAV encoding mini-PCDH15) can be administered to the patients (e.g., patients with Usher 1F syndrome or hereditary hearing loss) once in a life time, every 5 years, every 2 years, every year, every 6 months, every 3 months, every month, every two weeks, every week. In other embodiments, the administration of the rAAV (e.g., rAAV encoding mini-PCDH15) can be administered to the patients (e.g., patients with Usher 1F syndrome or hereditary hearing loss) in combination with other known treatment methods for Usher 1F or hereditary hearing (e.g., Vitamin A supplementation).

(ii) Methods for Correcting Mutations in PCDH15 Gene Using Base Editors

Other aspects of the present disclosure relates to method of treating hearing loss and/or blindness (e.g., Usher Syndrome type 1F) by correcting one or more mutations (e.g., point mutations) in a relevant gene (e.g., PCDH15) in a target cell (e.g., inner hair cell, outer hair cell, and photoreceptors) using base editors (e.g., ABEmax). Non-limiting exemplary mutations can be found in table 1.

In some embodiments, the method for correcting a point mutation of PCDH15 on a target sequence comprises contacting the target sequence with a base editor and a guide RNA. A target sequence, as used herein, refers to a sequence within a nucleic acid molecule that is deaminated by a deaminase or a fusion protein comprising a deaminase, (e.g., a dCas9-adenosine deaminase fusion protein). The present disclosure provides methods of using the base editor, or complexes comprising a guide nucleic acid (e.g., gRNA) and a nucleobase editor provided herein. For example, some aspects of this disclosure provide methods comprising contacting a DNA molecule with any of the fusion proteins provided herein, and with at least one guide nucleic acid (e.g., guide RNA), wherein the guide nucleic acid, (e.g., guide RNA) is about 15-100 nucleotides long and comprises a sequence of at least 10 contiguous nucleotides that is complementary to a target sequence.

In some embodiments, the target DNA sequence comprises a G>A or C>T (e.g., c.733C>T mutation on the coding strand of PCDH15 results in a G>A point mutation on the complementary strand) point mutation associated with a disease or disorder, and wherein the deamination of the mutant A base results in a sequence that is not associated with a disease or disorder. In some embodiments, the target DNA sequence encodes a protein, and the point mutation is in a codon and results in a change in the amino acid encoded by the mutant codon as compared to the wild-type codon. In some embodiments, the deamination of the mutant A results in a change of the amino acid encoded by the mutant codon. In some embodiments, the deamination of the mutant A results in the codon encoding the wild-type amino acid. In some embodiments, the target sequence can is in the genome of a subject. In some examples, the subject is a mammal. In one example, the subject is a human. In other examples, the subject is a non-human mammal, such as mouse, rat, cat, dog, sheep, rabbit, horse, cow, goat, pig, guinea pig, hamster, chicken, turkey, or a non-human primate (e.g., cynomolgus monkey).

A base editor (BE)," or "nucleobase editor (NBE)", as used herein, refers to an agent comprising a polypeptide that is capable of making a modification to a base (e.g., A, T, C, G, or U) within a nucleic acid sequence (e.g., DNA or RNA). In some embodiments, the base editor is capable of deaminating a base within a nucleic acid. In some embodiments, the base editor is capable of deaminating a base within a DNA molecule. In some embodiments, the base editor is capable of deaminating an adenine (A) in DNA. In some embodiments, the base editor is a fusion protein comprising a nucleic acid programmable DNA binding protein (napDNAbp) fused to an adenosine deaminase. In some embodiments, the base editor is a Cas9 protein fused to an adenosine deaminase. In some embodiments, the base editor is a Cas9 nickase (nCas9) fused to an adenosine deaminase. In some embodiments, the base editor is a nuclease-inactive Cas9 (dCas9) fused to an adenosine deaminase. In some embodiments, the base editor is ABEmax. In some embodiments, the base editor is ABE_7. In some embodiments, the base editor is ABE_8. In some embodiments, the base editor is ABE_7. In some embodiments, the base editor is ABE_V-RQR. In some embodiments, any of the base editors described herein can be fused with a Cas9 protein (e.g., Cas9 (D10A) or Cas9 (N)) with or without a linker.

An exemplary amino acid sequence for ABEmax-Cas9 D10A) is set forth in SEQ ID NO: 157:

MKRTADGSEFESPKKKRKVSEVEFSHEYWMRHALTLAKRAWDEREVPVGAVLVHNNRVIGEGWN

RPIGRHDPTAHAEIMALRQGGLVMQNYRLIDATLYVTLEPCVMCAGAMIHSRIGRVVFGARDAK

TGAAGSLMDVLHHPGMNHRVEITEGILADECAALLSDFFRMRRQEIKAQKKAQSSTDSGGSSGG

SSGSETPGTSESATPESSGGSSGGSSEVEFSHEYWMRHALTLAKRARDEREVPVGAVLVLNNRV

-continued

IGEGWNRAIGLHDPTAHAEIMALRQGGLVMQNYRLIDATLYVTFEPCVMCAGAMIHSRIGRVVF

GVRNAKTGAAGSLMDVLHYPGMNHRVEITEGILADECAALLCYFFRMPRQVFNAQKKAQSSTDS

GGSSGGSSGSETPGTSESATPESSGGSSGGSDKKYSIGLAIGTNSVGWAVITDEYKVPSKKFKV

LGNTDRHSIKKNLIGALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLENLI

AQLPGEKKNGLFGNLIALSLGLTPNFKSNFDLAEDAKLQLSKDTYDDDLDNLLAQIGDQYADLF

LAAKNLSDAILLSDILRVNTEITKAPLSASMIKRYDEHHQDLTLLKALVRQQLPEKYKEIFFDQ

SKNGYAGYIDGGASQEEFYKFIKPILEKMDGTEELLVKLNREDLLRKQRTFDNGSIPHQIHLGE

LHAILRRQEDFYPFLKDNREKIEKILTFRIPYYVGPLARGNSRFAWMTRKSEETITPWNFEEVV

DKGASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLDNE

ENEDILEDIVLTLTLFEDREMIEERLKTYAHLFDDKVMKQLKRRRYTGWGRLSRKLINGIRDKQ

SGKTILDFLKSDGFANRNFMQLIHDDSLTFKEDIQKAQVSGQGDSLHEHIANLAGSPAIKKGIL

QTVKVVDELVKVMGRHKPENIVIEMARENQTTQKGQKNSRERMKRIEEGIKELGSQILKEHPVE

NTQLQNEKLYLYYLQNGRDMYVDQELDINRLSDYDVDHIVPQSFLKDDSIDNKVLTRSDKNRGK

SDNVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAVVG

TALIKKYPKLESEFVYGDYKVYDVRKMIAKSEQEIGKATAKYFFYSNIMNFFKTEITLANGEIR

KRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKG

YKEVKKDLIIKLPKYSLFELENGRKRMLASAGELQKGNELALPSKYVNFLYLASHYEKLKGSPE

DNEQKQLFVEQHKHYLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQLGGD

An exemplary nucleic acid sequence encoding ABEmax-Cas9 (D10A) is set forth in SEQ
ID NO: 158:
ATGAAACGGACAGCCGACGGAAGCGAGTTCGAGTCACCAAAGAAGAAGCGGAAAGTCTCTGAAG

TCGAGTTTAGCCACGAGTATTGGATGAGGCACGCACTGACCCTGGCAAAGCGAGCATGGGATGA

AAGAGAAGTCCCCGTGGGCGCCGTGCTGGTGCACAACAATAGAGTGATCGGAGAGGGATGGAAC

AGGCCAATCGGCCGCCACGACCCTACCGCACACGCAGAGATCATGGCACTGAGGCAGGGGAGGCC

TGGTCATGCAGAATTACCGCCTGATCGATGCCACCCTGTATGTGACACTGGAGCCATGCGTGAT

GTGCGCAGGAGCAATGATCCACAGCAGGATCGGAAGAGTGGTGTTCGGAGCACGGGACGCCAAG

ACCGGCGCAGCAGGCTCCCTGATGGATGTGCTGCACCACCCCGGCATGAACCACGGGTGGAGA

TCACAGAGGGAATCCTGGCAGACGAGTGCGCCGCCCTGCTGAGCGATTTCTTTAGAATGCGGAG

ACAGGAGATCAAGGCCCAGAAGAAGGCACAGAGCTCCACCGACTCTGGAGGATCTAGCGGAGGA

TCCTCTGGAAGCGAGACACCAGGCACAAGCGAGTCCGCCACACCAGAGAGCTCCGGCGGCTCCT

CCGGAGGATCCTCTGAGGTGGAGTTTTCCCACGAGTACTGGATGAGACATGCCCTGACCCTGGC

CAAGAGGGCACGCGATGAGAGGGAGGTGCCTGTGGGAGCCGTGCTGGTGCTGAACAATAGAGTG

ATCGGCGAGGGCTGGAACAGAGCCATCGGCCTGCACGACCCAACAGCCCATGCCGAAATTATGG

CCCTGAGACAGGGCGGCCTGGTCATGCAGAACTACAGACTGATTGACGCCACCCTGTACGTGAC

ATTCGAGCCTTGCGTGATGTGCGCCGGCGCCATGATCCACTCTAGGATCGGCCGCGTGGTGTTT

GGCGTGAGGAACGCAAAAACCGGCGCCGCAGGCTCCCTGATGGACGTGCTGCACTACCCCGGCA

-continued

```
TGAATCACCGCGTCGAAATTACCGAGGGAATCCTGGCAGATGAATGTGCCGCCCTGCTGTGCTA

TTTCTTTCGGATGCCTAGACAGGTGTTCAATGCTCAGAAGAAGGCCCAGAGCTCCACCGACTCC

GGAGGATCTAGCGGAGGCTCCTCTGGCTCTGAGACACCTGGCACAAGCGAGAGCGCAACACCTG

AAAGCAGCGGGGGCAGCAGCGGGGGGTCAGACAAGAAGTACAGCATCGGCCTGGCCATCGGCAC

CAACTCTGTGGGCTGGGCCGTGATCACCGACGAGTACAAGGTGCCCAGCAAGAAATTCAAGGTG

CTGGGCAACACCGACCGGCACAGCATCAAGAAGAACCTGATCGGAGCCCTGCTGTTCGACAGCG

GCGAAACAGCCGAGGCCACCCGGCTGAAGAGAACCGCCAGAAGAAGATACACCAGACGGAAGAA

CCGGATCTGCTATCTGCAAGAGATCTTCAGCAACGAGATGGCCAAGGTGGACGACAGCTTCTTC

CACAGACTGGAAGAGTCCTTCCTGGTGGAAGAGGATAAGAAGCACGAGCGGCACCCCATCTTCG

GCAACATCGTGGACGAGGTGGCCTACCACGAGAAGTACCCCACCATCTACCACCTGAGAAAGAA

ACTGGTGGACAGCACCGACAAGGCCGACCTGCGGCTGATCTATCTGGCCCTGGCCCACATGATC

AAGTTCCGGGGCCACTTCCTGATCGAGGGCGACCTGAACCCCGACAACAGCGACGTGGACAAGC

TGTTCATCCAGCTGGTGCAGACCTACAACCAGCTGTTCGAGGAAAACCCCATCAACGCCAGCGG

CGTGGACGCCAAGGCCATCCTGTCTGCCAGACTGAGCAAGAGCAGACGGCTGGAAAATCTGATC

GCCCAGCTGCCCGGCGAGAAGAAGAATGGCCTGTTCGGAAACCTGATTGCCCTGAGCCTGGGCC

TGACCCCCAACTTCAAGAGCAACTTCGACCTGGCCGAGGATGCCAAACTGCAGCTGAGCAAGGA

CACCTACGACGACGACCTGGACAACCTGCTGGCCCAGATCGGCGACCAGTACGCCGACCTGTTT

CTGGCCGCCAAGAACCTGTCCGACGCCATCCTGCTGAGCGACATCCTGAGAGTGAACACCGAGA

TCACCAAGGCCCCCCTGAGCGCCTCTATGATCAAGAGATACGACGAGCACCACCAGGACCTGAC

CCTGCTGAAAGCTCTCGTGCGGCAGCAGCTGCCTGAGAAGTACAAAGAGATTTTCTTCGACCAG

AGCAAGAACGGCTACGCCGGCTACATTGACGGCGGAGCCAGCCAGGAAGAGTTCTACAAGTTCA

TCAAGCCCATCCTGGAAAAGATGGACGGCACCGAGGAACTGCTCGTGAAGCTGAACAGAGAGGA

CCTGCTGCGGAAGCAGCGGACCTTCGACAACGGCAGCATCCCCCACCAGATCCACCTGGGAGAG

CTGCACGCCATTCTGCGGCGGCAGGAAGATTTTTACCCATTCCTGAAGGACAACCGGGAAAAGA

TCGAGAAGATCCTGACCTTCCGCATCCCCTACTACGTGGGCCCTCTGGCCAGGGGAAACAGCAG

ATTCGCCTGGATGACCAGAAAGAGCGAGGAAACCATCACCCCCTGGAACTTCGAGGAAGTGGTG

GACAAGGGCGCTTCCGCCCAGAGCTTCATCGAGCGGATGACCAACTTCGATAAGAACCTGCCCA

ACGAGAAGGTGCTGCCCAAGCACAGCCTGCTGTACGAGTACTTCACCGTGTATAACGAGCTGAC

CAAAGTGAAATACGTGACCGAGGGAATGAGAAAGCCCGCCTTCCTGAGCGGCGAGCAGAAAAAG

GCCATCGTGGACCTGCTGTTCAAGACCAACCGGAAAGTGACCGTGAAGCAGCTGAAAGAGGACT

ACTTCAAGAAAATCGAGTGCTTCGACTCCGTGGAAATCTCCGGCGTGGAAGATCGGTTCAACGC

CTCCCTGGGCACATACCACGATCTGCTGAAAATTATCAAGGACAAGGACTTCCTGGACAATGAG

GAAAACGAGGACATTCTGGAAGATATCGTGCTGACCCTGACACTGTTTGAGGACAGAGAGATGA

TCGAGGAACGGCTGAAAACCTATGCCCACCTGTTCGACGACAAAGTGATGAAGCAGCTGAAGCG

GCGGAGATACACCGGCTGGGGCAGGCTGAGCCGGAAGCTGATCAACGGCATCCGGGACAAGCAG

TCCGGCAAGACAATCCTGGATTTCCTGAAGTCCGACGGCTTCGCCAACAGAAACTTCATGCAGC

TGATCCACGACGACAGCCTGACCTTTAAAGAGGACATCCAGAAAGCCCAGGTGTCCGGCCAGGG

CGATAGCCTGCACGAGCACATTGCCAATCTGGCCGGCAGCCCCGCCATTAAGAAGGGCATCCTG

CAGACAGTGAAGGTGGTGGACGAGCTCGTGAAAGTGATGGGCCGGCACAAGCCCGAGAACATCG

TGATCGAAATGGCCAGAGAGAACCAGACCACCCAGAAGGGACAGAAGAACAGCCGCGAGAGAAT
```

-continued

GAAGCGGATCGAAGAGGGCATCAAAGAGCTGGGCAGCCAGATCCTGAAAGAACACCCCGTGGAA

AACACCCAGCTGCAGAACGAGAAGCTGTACCTGTACTACCTGCAGAATGGGCGGGATATGTACG

TGGACCAGGAACTGGACATCAACCGGCTGTCCGACTACGATGTGGACCATATCGTGCCTCAGAG

CTTTCTGAAGGACGACTCCATCGACAACAAGGTGCTGACCAGAAGCGACAAGAACCGGGGCAAG

AGCGACAACGTGCCCTCCGAAGAGGTCGTGAAGAAGATGAAGAACTACTGGCGGCAGCTGCTGA

ACGCCAAGCTGATTACCCAGAGAAAGTTCGACAATCTGACCAAGGCCGAGAGAGGCGGCCTGAG

CGAACTGGATAAGGCCGGCTTCATCAAGAGACAGCTGGTGGAAACCCGGCAGATCACAAAGCAC

GTGGCACAGATCCTGGACTCCCGGATGAACACTAAGTACGACGAGAATGACAAGCTGATCCGGG

AAGTGAAAGTGATCACCCTGAAGTCCAAGCTGGTGTCCGATTTCCGGAAGGATTTCCAGTTTTA

CAAAGTGCGCGAGATCAACAACTACCACCACGCCCACGACGCCTACCTGAACGCCGTCGTGGGA

ACCGCCCTGATCAAAAAGTACCCTAAGCTGGAAAGCGAGTTCGTGTACGGCGACTACAAGGTGT

ACGACGTGCGGAAGATGATCGCCAAGAGCGAGCAGGAAATCGGCAAGGCTACCGCCAAGTACTT

CTTCTACAGCAACATCATGAACTTTTTCAAGACCGAGATTACCCTGGCCAACGGCGAGATCCGG

AAGCGGCCTCTGATCGAGACAAACGGCGAAACCGGGGAGATCGTGTGGGATAAGGGCCGGGATT

TTGCCACCGTGCGGAAAGTGCTGAGCATGCCCCAAGTGAATATCGTGAAAAAGACCGAGGTGCA

GACAGGCGGCTTCAGCAAAGAGTCTATCCTGCCCAAGAGGAACAGCGATAAGCTGATCGCCAGA

AAGAAGGACTGGGACCCTAAGAAGTACGGCGGCTTCGACAGCCCCACCGTGGCCTATTCTGTGC

TGGTGGTGGCCAAAGTGGAAAAGGGCAAGTCCAAGAAACTGAAGAGTGTGAAAGAGCTGCTGGG

GATCACCATCATGGAAAGAAGCAGCTTCGAGAAGAATCCCATCGACTTTCTGGAAGCCAAGGGC

TACAAAGAAGTGAAAAAGGACCTGATCATCAAGCTGCCTAAGTACTCCCTGTTCGAGCTGGAAA

ACGGCCGGAAGAGAATGCTGGCCTCTGCCGGCGAACTGCAGAAGGGAAACGAACTGGCCCTGCC

CTCCAAATATGTGAACTTCCTGTACCTGGCCAGCCACTATGAGAAGCTGAAGGGCTCCCCCGAG

GATAATGAGCAGAAACAGCTGTTTGTGGAACAGCACAAGCACTACCTGGACGAGATCATCGAGC

AGATCAGCGAGTTCTCCAAGAGAGTGATCCTGGCCGACGCTAATCTGGACAAAGTGCTGTCCGC

CTACAACAAGCACCGGGATAAGCCCATCAGAGAGCAGGCCGAGAATATCATCCACCTGTTTACC

CTGACCAATCTGGGAGCCCCTGCCGCCTTCAAGTACTTTGACACCACCATCGACCGGAAGAGGT

ACACCAGCACCAAAGAGGTGCTGGACGCCACCCTGATCCACCAGAGCATCACCGGCCTGTACGA

GACACGGATCGACCTGTCTCAGCTGGGAGGTGAC

An exemplary amino acid sequence for ABE_7-Cas9(D10A) is set forth in SEQ ID NO:
159:
MSEVEFSHEYWMRHALTLAKRAWDEREVPVGAVLVHNNRVIGEGWNRPIGRHDPTAHAEIMALR

QGGLVMQNYRLIDATLYVTLEPCVMCAGAMIHSRIGRVVFGARDAKTGAAGSLMDVLHHPGMNH

RVEITEGILADECAALLSDFFRMRRQEIKAQKKAQSSTDSGGSSGGSSGSETPGTSESATPESS

GGSSGGSSEVEFSHEYWMRHALTLAKRARDEREVPVGAVLVLNNRVIGEGWNRAIGLHDPTAHA

EIMALRQGGLVMQNYRLIDATLYVTFEPCVMCAGAMIHSRIGRVVFGVRNAKTGAAGSLMDVLH

YPGMNHRVEITEGILADECAALLCYFFRMPRQVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGALL

FDSGETAEATRLKRTARRRYTRRKNRICYLQEIFSNEMAKVDDSFFHRLEESFLVEEDKKHERH

PIFGNIVDEVAYHEKYPTIYHLRKKLVDSTDKADLRLIYLALAHMIKFRGHFLIEGDLNPDNSD

VDKLFIQLVQTYNQLFEENPINASGVDAKAILSARLSKSRRLENLIAQLPGEKKNGLFGNLIAL

SLGLTPNFKSNFDLAEDAKLQLSKDTYDDDLDNLLAQIGDQYADLFLAAKNLSDAILLSDILRV

NTEITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLKDN

REKIEKILTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNRKVTVKQL

KEDYFKKIECFDSVEISGVEDRFNASLGTYHDLLKIIKDKDFLDNEENEDILEDIVLTLTLFED

REMIEERLKTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVKVMGRHKP

ENIVIEMARENQTTQKGQKNSRERMKRIEEGIKELGSQILKEHPVENTQLQNEKLYLYLQNGR

DMYVDQELDINRLSDYDVDHIVPQSFLKDDSIDNKVLTRSDKNRGKSDNVPSEEVVKKMKNYWR

QLLNAKLITQRKFDNLTKAERGGLSELDKAGFIKRQLVETRQITKHVAQILDSRMNTKYDENDK

LIREVKVITLKSKLVSDFRKDFQFYKVREINNYHHAHDAYLNAVVGTALIKKYPKLESEFVYGD

YKVYDVRKMIAKSEQEIGKATAKYFFYSNIMNFFKTEITLANGEIRKRPLIETNGETGEIVWDK

GRDFATVRKVLSMPQVNIVKKTEVQTGGFSKESILPKRNSDKLIARKKDWDPKKYGGFDSPTVA

YSVLVVAKVEKGKSKKLKSVKELLGITIMERSSFEKNPIDFLEAKGYKEVKKDLIIKLPKYSLF

ELENGRKRMLASAGELQKGNELALPSKYVNFLYLASHYEKLKGSPEDNEQKQLFVEQHKHYLDE

IIEQISEFSKRVILADANLDKVLSAYNKHRDKPIREQAENIIHLFTLTNLGAPAAFKYFDTTID

RKRYTSTKEVLDATLIHQSITGLYETRIDLSQLGGD

An exemplary nucleic acid sequence encoding ABE_7-Cas9 (D10A) is set forth in SEQ ID NO: 160:
ATGTCCGAAGTCGAGTTTTCCCATGAGTACTGGATGAGACACGCATTGACTCTCGCAAAGAGGG

CTTGGGATGAACGCGAGGTGCCCGTGGGGGCAGTACTCGTGCATAACAATCGCGTAATCGGCGA

AGGTTGGAATAGGCCGATCGGACGCCACGACCCCACTGCACATGCGGAAATCATGGCCCTTCGA

CAGGGAGGGCTTGTGATGCAGAATTATCGACTTATCGATGCGACGCTGTACGTCACGCTTGAAC

CTTGCGTAATGTGCGCGGGAGCTATGATTCACTCCCGCATTGGACGAGTTGTATTCGGTGCCCG

CGACGCCAAGACGGGTGCCGCAGGTTCACTGATGGACGTGCTGCATCACCCAGGCATGAACCAC

CGGGTAGAAATCACAGAAGGCATATTGGCGGACGAATGTGCGGCGCTGTTGTCCGACTTTTTTC

GCATGCGGAGGCAGGAGATCAAGGCCCAGAAAAAAGCACAATCCTCTACTGACTCTGGTGGTTC

TTCTGGTGGTTCTAGCGGCAGCGAGACTCCCGGGACCTCAGAGTCCGCCACACCCGAAAGTTCT

GGTGGTTCTTCTGGTGGTTCTTCCGAAGTCGAGTTTTCCCATGAGTACTGGATGAGACACGCAT

TGACTCTCGCAAAGAGGGCTCGAGATGAACGCGAGGTGCCCGTGGGGGCAGTACTCGTGCTCAA

CAATCGCGTAATCGGCGAAGGTTGGAATAGGGCAATCGGACTCCACGACCCCACTGCACATGCG

GAAATCATGGCCCTTCGACAGGGAGGGCTTGTGATGCAGAATTATCGACTTATCGATGCGACGC

TGTACGTCACGTTTGAACCTTGCGTAATGTGCGCGGGAGCTATGATTCACTCCCGCATTGGACG

AGTTGTATTCGGTGTTCGCAACGCCAAGACGGGTGCCGCAGGTTCACTGATGGACGTGCTGCAT

TACCCAGGCATGAACCACCGGGTAGAAATCACAGAAGGCATATTGGCGGACGAATGTGCGGCGC

TGTTGTGTTACTTTTTTCGCATGCCCAGGCAGGTCTTTAACGCCCAGAAAAAAGCACAATCCTC

TACTGACTCTGGTGGTTCTTCTGGTGGTTCTAGCGGCAGCGAGACTCCCGGGACCTCAGAGTCC

GCCACACCCGAAAGTTCTGGTGGTTCTTCTGGTGGTTCTGATAAAAAGTATTCTATTGGTTTAG

CCATCGGCACTAATTCCGTTGGATGGGCTGTCATAACCGATGAATACAAAGTACCTTCAAAGAA

ATTTAAGGTGTTGGGGAACACAGACCGTCATTCGATTAAAAAGAATCTTATCGGTGCCCTCCTA

TTCGATAGTGGCGAAACGGCAGAGGCGACTCGCCTGAAACGAACCGCTCGGAGAAGGTATACAC

GTCGCAAGAACCGAATATGTTACTTACAAGAAATTTTTAGCAATGAGATGGCCAAAGTTGACGA

-continued

```
TTCTTTCTTTCACCGTTTGGAAGAGTCCTTCCTTGTCGAAGAGGACAAGAAACATGAACGGCAC

CCCATCTTTGGAAACATAGTAGATGAGGTGGCATATCATGAAAAGTACCCAACGATTTATCACC

TCAGAAAAAAGCTAGTTGACTCAACTGATAAAGCGGACCTGAGGTTAATCTACTTGGCTCTTGC

CCATATGATAAAGTTCCGTGGGCACTTTCTCATTGAGGGTGATCTAAATCCGGACAACTCGGAT

GTCGACAAACTGTTCATCCAGTTAGTACAAACCTATAATCAGTTGTTTGAAGAGAACCCTATAA

ATGCAAGTGGCGTGGATGCGAAGGCTATTCTTAGCGCCCGCCTCTCTAAATCCCGACGGCTAGA

AAACCTGATCGCACAATTACCCGGAGAGAAGAAAAATGGGTTGTTCGGTAACCTTATAGCGCTC

TCACTAGGCCTGACACCAAATTTTAAGTCGAACTTCGACTTAGCTGAAGATGCCAAATTGCAGC

TTAGTAAGGACACGTACGATGACGATCTCGACAATCTACTGGCACAAATTGGAGATCAGTATGC

GGACTTATTTTTGGCTGCCAAAAACCTTAGCGATGCAATCCTCCTATCTGACATACTGAGAGTT

AATACTGAGATTACCAAGGCGCCGTTATCCGCTTCAATGATCAAAAGGTACGATGAACATCACC

AAGACTTGACACTTCTCAAGGCCCTAGTCCGTCAGCAACTGCCTGAGAAATATAAGGAAATATT

CTTTGATCAGTCGAAAAACGGGTACGCAGGTTATATTGACGGCGGAGCGAGTCAAGAGGAATTC

TACAAGTTTATCAAACCCATATTAGAGAAGATGGATGGGACGGAAGAGTTGCTTGTAAAACTCA

ATCGCGAAGATCTACTGCGAAAGCAGCGGACTTTCGACAACGGTAGCATTCCACATCAAATCCA

CTTAGGCGAATTGCATGCTATACTTAGAAGGCAGGAGGATTTTTATCCGTTCCTCAAAGACAAT

CGTGAAAAGATTGAGAAAATCCTAACCTTTCGCATACCTTACTATGTGGGACCCCTGGCCCGAG

GGAACTCTCGGTTCGCATGGATGACAAGAAAGTCCGAAGAAACGATTACTCCATGGAATTTTGA

GGAAGTTGTCGATAAAGGTGCGTCAGCTCAATCGTTCATCGAGAGGATGACCAACTTTGACAAG

AATTTACCGAACGAAAAAGTATTGCCTAAGCACAGTTTACTTTACGAGTATTTCACAGTGTACA

ATGAACTCACGAAAGTTAAGTATGTCACTGAGGGCATGCGTAAACCCGCCTTTCTAAGCGGAGA

ACAGAAGAAAGCAATAGTAGATCTGTTATTCAAGACCAACCGCAAAGTGACAGTTAAGCAATTG

AAAGAGGACTACTTTAAGAAAATTGAATGCTTCGATTCTGTCGAGATCTCCGGGGTAGAAGATC

GATTTAATGCGTCACTTGGTACGTATCATGACCTCCTAAAGATAATTAAAGATAAGGACTTCCT

GGATAACGAAGAGAATGAAGATATCTTAGAAGATATAGTGTTGACTCTTACCCTCTTTGAAGAT

CGGGAAATGATTGAGGAAAGACTAAAAACATACGCTCACCTGTTCGACGATAAGGTTATGAAAC

AGTTAAAGAGGCGTCGCTATACGGGCTGGGGACGATTGTCGCGGAAACTTATCAACGGGATAAG

AGACAAGCAAAGTGGTAAAACTATTCTCGATTTTCTAAAGAGCGACGGCTTCGCCAATAGGAAC

TTTATGCAGCTGATCCATGATGACTCTTTAACCTTCAAAGAGGATATACAAAAGGCACAGGTTT

CCGGACAAGGGGACTCATTGCACGAACATATTGCGAATCTTGCTGGTTCGCCAGCCATCAAAAA

GGGCATACTCCAGACAGTCAAAGTAGTGGATGAGCTAGTTAAGGTCATGGGACGTCACAAACCG

GAAAACATTGTAATCGAGATGGCACGCGAAAATCAAACGACTCAGAAGGGGCAAAAAAACAGTC

GAGAGCGGATGAAGAGAATAGAAGAGGGTATTAAAGAACTGGGCAGCCAGATCTTAAAGGAGCA

TCCTGTGGAAAATACCCAATTGCAGAACGAGAAACTTTACCTCTATTACCTACAAAATGGAAGG

GACATGTATGTTGATCAGGAACTGGACATAAACCGTTTATCTGATTACGACGTCGATCACATTG

TACCCCAATCCTTTTTGAAGGACGATTCAATCGACAATAAAGTGCTTACACGCTCGGATAAGAA

CCGAGGGAAAAGTGACAATGTTCCAAGCGAGGAAGTCGTAAAGAAAATGAAGAACTATTGGCGG

CAGCTCCTAAATGCGAAACTGATAACGCAAAGAAAGTTCGATAACTTAACTAAAGCTGAGAGGG

GTGGCTTGTCTGAACTTGACAAGGCCGGATTTATTAAACGTCAGCTCGTGGAAACCCGCCAAAT

CACAAAGCATGTTGCACAGATACTAGATTCCCGAATGAATACGAAATACGACGAGAACGATAAG

CTGATTCGGGAAGTCAAAGTAATCACTTTAAAGTCAAAATTGGTGTCGGACTTCAGAAAGGATT
```

-continued

TTCAATTCTATAAAGTTAGGGAGATAAATAACTACCACCATGCGCACGACGCTTATCTTAATGC

CGTCGTAGGGACCGCACTCATTAAGAAATACCCGAAGCTAGAAAGTGAGTTTGTGTATGGTGAT

TACAAAGTTTATGACGTCCGTAAGATGATCGCGAAAAGCGAACAGGAGATAGGCAAGGCTACAG

CCAAATACTTCTTTTATTCTAACATTATGAATTTCTTTAAGACGGAAATCACTCTGGCAAACGG

AGAGATACGCAAACGACCTTTAATTGAAACCAATGGGGAGACAGGTGAAATCGTATGGGATAAG

GGCCGGGACTTCGCGACGGTGAGAAAAGTTTTGTCCATGCCCCAAGTCAACATAGTAAAGAAAA

CTGAGGTGCAGACCGGAGGGTTTTCAAAGGAATCGATTCTTCCAAAAAGGAATAGTGATAAGCT

CATCGCTCGTAAAAAGGACTGGGACCCGAAAAAGTACGGTGGCTTCGATAGCCCTACAGTTGCC

TATTCTGTCCTAGTAGTGGCAAAAGTTGAGAAGGGAAAATCCAAGAAACTGAAGTCAGTCAAAG

AATTATTGGGGATAACGATTATGGAGCGCTCGTCTTTTGAAAAGAACCCCATCGACTTCCTTGA

GGCGAAAGGTTACAAGGAAGTAAAAAAGGATCTCATAATTAAACTACCAAAGTATAGTCTGTTT

GAGTTAGAAAATGGCCGAAAACGGATGTTGGCTAGCGCCGGAGAGCTTCAAAAGGGGAACGAAC

TCGCACTACCGTCTAAATACGTGAATTTCCTGTATTTAGCGTCCCATTACGAGAAGTTGAAAGG

TTCACCTGAAGATAACGAACAGAAGCAACTTTTTGTTGAGCAGCACAAACATTATCTCGACGAA

ATCATAGAGCAAATTTCGGAATTCAGTAAGAGAGTCATCCTAGCTGATGCCAATCTGGACAAAG

TATTAAGCGCATACAACAAGCACAGGGATAAACCCATACGTGAGCAGGCGGAAAATATTATCCA

TTTGTTTACTCTTACCAACCTCGGCGCTCCAGCCGCATTCAAGTATTTTGACACAACGATAGAT

CGCAAACGATACACTTCTACCAAGGAGGTGCTAGACGCGACACTGATTCACCAATCCATCACGG

GATTATATGAAACTCGGATAGATTTGTCACAGCTTGGGGGTGA

An exemplary amino acid sequence for ABE_8-Cas9 (D10A) is set forth in SEQ ID NO:
161:
MKRTADGSEFESPKKKRKVSEVEFSHEYWMRHALTLAKRARDEREVPVGAVLVLNNRVIGEGWN

RAIGLHDPTAHAEIMALRQGGLVMQNYRLIDATLYVTFEPCVMCAGAMIHSRIGRVVFGVRNSK

RGAAGSLMNVLNYPGMNHRVEITEGILADECAALLCDFYRMPRQVFNAQKKAQSSINSGGSSGG

SSGSETPGTSESATPESSGGSSGGSDKKYSIGLAIGTNSVGWAVITDEYKVPSKKFKVLGNTDR

HSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHF

LIEGDLNPDNSDVDKLFIQLVQTYNQLFEENPINASGVDAKAILSARLSKSRRLENLIAQLPGE

KKNGLFGNLIALSLGLTPNFKSNFDLAEDAKLQLSKDTYDDDLDNLLAQIGDQYADLFLAAKNL

SDAILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAILR

RQEDFYPFLKDNREKIEKILTFRIPYYVGPLARGNSRFAWMTRKSEETITPWNFEEVVDKGASA

QSFIERMTNFDKNLPNEKVLPKHSLLYEYFTVYNELTKVKYVTEGMRKPAFLSGEQKKAIVDLL

FKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTIL

DFLKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQLQN

EKLYLYYLQNGRDMYVDQELDINRLSDYDVDHIVPQSFLKDDSIDNKVLTRSDKNRGKSDNVPS

EEVVKKMKNYWRQLLNAKLITQRKFDNLTKAERGGLSELDKAGFIKRQLVETRQITKHVAQILD

SRMNTKYDENDKLIREVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEITLANGEIRKRPLIE

-continued

TNGETGEIVWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAKGYKEVKK

DLIIKLPKYSLFELENGRKRMLASAGELQKGNELALPSKYVNFLYLASHYEKLKGSPEDNEQKQ

LFVEQHKHYLDEIIEQISEFSKRVILADANLDKVLSAYNKHRDKPIREQAENIIHLFTLTNLGA

PAAFKYFDTTIDRKRYTSTKEVLDATLIHQSITGLYETRIDLSQLGGD

An exemplary nucleic acid sequence encoding ABE_8-Cas9 (D10A) is set forth in SEQ
ID NO: 162:
ATGAAACGGACAGCCGACGGAAGCGAGTTCGAGTCACCAAAGAAGAAGCGGAAAGTCTCTGAGG

TGGAGTTTTCCCACGAGTACTGGATGAGACATGCCCTGACCCTGGCCAAGAGGGCACGGGATGA

GAGGGAGGTGCCTGTGGGAGCCGTGCTGGTGCTGAACAATAGAGTGATCGGCGAGGGCTGGAAC

AGAGCCATCGGCCTGCACGACCCAACAGCCCATGCCGAAATTATGGCCCTGAGACAGGGCGGCC

TGGTCATGCAGAACTACAGACTGATTGACGCCACCCTGTACGTGACATTCGAGCCTTGCGTGAT

GTGCGCCGGCGCCATGATCCACTCTAGGATCGGCCGCGTGGTGTTTGGCGTGAGGAACTCAAAA

AGAGGCGCCGCAGGCTCCCTGATGAACGTGCTGAACTACCCCGGCATGAATCACCGCGTCGAAA

TTACCGAGGGAATCCTGGCAGATGAATGTGCCGCCCTGCTGTGCGATTTCTATCGGATGCCTAG

ACAGGTGTTCAATGCTCAGAAGAAGGCCCAGAGCTCCATCAACTCCGGAGGATCTAGCGGAGGC

TCCTCTGGCTCTGAGACACCTGGCACAAGCGAGAGCGCAACACCTGAAAGCAGCGGGGGCAGCA

GCGGGGGGTCAGACAAGAAGTACAGCATCGGCCTGGCCATCGGCACCAACTCTGTGGGCTGGGC

CGTGATCACCGACGAGTACAAGGTGCCCAGCAAGAAATTCAAGGTGCTGGGCAACACCGACCGG

CACAGCATCAAGAAGAACCTGATCGGAGCCCTGCTGTTCGACAGCGGCGAAACAGCCGAGGCCA

CCCGGCTGAAGAGAACCGCCAGAAGAAGATACACCAGACGGAAGAACCGGATCTGCTATCTGCA

AGAGATCTTCAGCAACGAGATGGCCAAGGTGGACGACAGCTTCTTCCACAGACTGGAAGAGTCC

TTCCTGGTGGAAGAGGATAAGAAGCACGAGCGGCACCCCATCTTCGGCAACATCGTGGACGAGG

TGGCCTACCACGAGAAGTACCCCACCATCTACCACCTGAGAAAGAAACTGGTGGACAGCACCGA

CAAGGCCGACCTGCGGCTGATCTATCTGGCCCTGGCCCACATGATCAAGTTCCGGGGCCACTTC

CTGATCGAGGGCGACCTGAACCCCGACAACAGCGACGTGGACAAGCTGTTCATCCAGCTGGTGC

AGACCTACAACCAGCTGTTCGAGGAAAACCCCATCAACGCCAGCGGCGTGGACGCCAAGGCCAT

CCTGTCTGCCAGACTGAGCAAGAGCAGACGGCTGGAAAATCTGATCGCCCAGCTGCCCGGCGAG

AAGAAGAATGGCCTGTTCGGAAACCTGATTGCCCTGAGCCTGGGCCTGACCCCCAACTTCAAGA

GCAACTTCGACCTGGCCGAGGATGCCAAACTGCAGCTGAGCAAGGACACCTACGACGACGACCT

GGACAACCTGCTGGCCCAGATCGGCGACCAGTACGCCGACCTGTTTCTGGCCGCCAAGAACCTG

TCCGACGCCATCCTGCTGAGCGACATCCTGAGAGTGAACACCGAGATCACCAAGGCCCCCCTGA

GCGCCTCTATGATCAAGAGATACGACGAGCACCACCAGGACCTGACCCTGCTGAAAGCTCTCGT

GCGGCAGCAGCTGCCTGAGAAGTACAAAGAGATTTTCTTCGACCAGAGCAAGAACGGCTACGCC

GGCTACATTGACGGCGGAGCCAGCCAGGAAGAGTTCTACAAGTTCATCAAGCCCATCCTGGAAA

AGATGGACGGCACCGAGGAACTGCTCGTGAAGCTGAACAGAGAGGACCTGCTGCGGAAGCAGCG

GACCTTCGACAACGGCAGCATCCCCCACCAGATCCACCTGGGAGAGCTGCACGCCATTCTGCGG

CGGCAGGAAGATTTTTACCCATTCCTGAAGGACAACCGGGAAAAGATCGAGAAGATCCTGACCT

TCCGCATCCCCTACTACGTGGGCCCTCTGGCCAGGGGAAACAGCAGATTCGCCTGGATGACCAG

AAAGAGCGAGGAAACCATCACCCCCTGGAACTTCGAGGAAGTGGTGGACAAGGGCGCTTCCGCC

CAGAGCTTCATCGAGCGGATGACCAACTTCGATAAGAACCTGCCCAACGAGAAGGTGCTGCCCA

AGCACAGCCTGCTGTACGAGTACTTCACCGTGTATAACGAGCTGACCAAAGTGAAATACGTGAC

-continued

```
CGAGGGAATGAGAAAGCCCGCCTTCCTGAGCGGCGAGCAGAAAAAGGCCATCGTGGACCTGCTG

TTCAAGACCAACCGGAAAGTGACCGTGAAGCAGCTGAAAGAGGACTACTTCAAGAAAATCGAGT

GCTTCGACTCCGTGGAAATCTCCGGCGTGGAAGATCGGTTCAACGCCTCCCTGGGCACATACCA

CGATCTGCTGAAAATTATCAAGGACAAGGACTTCCTGGACAATGAGGAAAACGAGGACATTCTG

GAAGATATCGTGCTGACCCTGACACTGTTTGAGGACAGAGAGATGATCGAGGAACGGCTGAAAA

CCTATGCCCACCTGTTCGACGACAAAGTGATGAAGCAGCTGAAGCGGCGGAGATACACCGGCTG

GGGCAGGCTGAGCCGGAAGCTGATCAACGGCATCCGGGACAAGCAGTCCGGCAAGACAATCCTG

GATTTCCTGAAGTCCGACGGCTTCGCCAACAGAAACTTCATGCAGCTGATCCACGACGACAGCC

TGACCTTTAAAGAGGACATCCAGAAAGCCCAGGTGTCCGGCCAGGGCGATAGCCTGCACGAGCA

CATTGCCAATCTGGCCGGCAGCCCCGCCATTAAGAAGGGCATCCTGCAGACAGTGAAGGTGGTG

GACGAGCTCGTGAAAGTGATGGGCCGGCACAAGCCCGAGAACATCGTGATCGAAATGGCCAGAG

AGAACCAGACCACCCAGAAGGGACAGAAGAACAGCCGCGAGAGAATGAAGCGGATCGAAGAGGG

CATCAAAGAGCTGGGCAGCCAGATCCTGAAAGAACACCCCGTGGAAAACACCCAGCTGCAGAAC

GAGAAGCTGTACCTGTACTACCTGCAGAATGGGCGGGATATGTACGTGGACCAGGAACTGGACA

TCAACCGGCTGTCCGACTACGATGTGGACCATATCGTGCCTCAGAGCTTTCTGAAGGACGACTC

CATCGACAACAAGGTGCTGACCAGAAGCGACAAGAACCGGGGCAAGAGCGACAACGTGCCCTCC

GAAGAGGTCGTGAAGAAGATGAAGAACTACTGGCGGCAGCTGCTGAACGCCAAGCTGATTACCC

AGAGAAAGTTCGACAATCTGACCAAGGCCGAGAGAGGCGGCCTGAGCGAACTGGATAAGGCCGG

CTTCATCAAGAGACAGCTGGTGGAAACCCGGCAGATCACAAAGCACGTGGCACAGATCCTGGAC

TCCCGGATGAACACTAAGTACGACGAGAATGACAAGCTGATCCGGGAAGTGAAAGTGATCACCC

TGAAGTCCAAGCTGGTGTCCGATTTCCGGAAGGATTTCCAGTTTTACAAAGTGCGCGAGATCAA

CAACTACCACCACGCCCACGACGCCTACCTGAACGCCGTCGTGGGAACCGCCCTGATCAAAAAG

TACCCTAAGCTGGAAAGCGAGTTCGTGTACGGCGACTACAAGGTGTACGACGTGCGGAAGATGA

TCGCCAAGAGCGAGCAGGAAATCGGCAAGGCTACCGCCAAGTACTTCTTCTACAGCAACATCAT

GAACTTTTTCAAGACCGAGATTACCCTGGCCAACGGCGAGATCCGGAAGCGGCCTCTGATCGAG

ACAAACGGCGAAACCGGGGAGATCGTGTGGGATAAGGGCCGGGATTTTGCCACCGTGCGGAAAG

TGCTGAGCATGCCCCAAGTGAATATCGTGAAAAAGACCGAGGTGCAGACAGGCGGCTTCAGCAA

AGAGTCTATCCTGCCCAAGAGGAACAGCGATAAGCTGATCGCCAGAAAGAAGGACTGGGACCCT

AAGAAGTACGGCGGCTTCGACAGCCCCACCGTGGCCTATTCTGTGCTGGTGGTGGCCAAAGTGG

AAAAGGGCAAGTCCAAGAAACTGAAGAGTGTGAAAGAGCTGCTGGGGATCACCATCATGGAAAG

AAGCAGCTTCGAGAAGAATCCCATCGACTTTCTGGAAGCCAAGGGCTACAAAGAAGTGAAAAAG

GACCTGATCATCAAGCTGCCTAAGTACTCCCTGTTCGAGCTGGAAAACGGCCGGAAGAGAATGC

TGGCCTCTGCCGGCGAACTGCAGAAGGGAAACGAACTGGCCCTGCCCTCCAAATATGTGAACTT

CCTGTACCTGGCCAGCCACTATGAGAAGCTGAAGGGCTCCCCCGAGGATAATGAGCAGAAACAG

CTGTTTGTGGAACAGCACAAGCACTACCTGGACGAGATCATCGAGCAGATCAGCGAGTTCTCCA

AGAGAGTGATCCTGGCCGACGCTAATCTGGACAAAGTGCTGTCCGCCTACAACAAGCACCGGGA

TAAGCCCATCAGAGAGCAGGCCGAGAATATCATCCACCTGTTTACCCTGACCAATCTGGGAGCC

CCTGCCGCCTTCAAGTACTTTGACACCACCATCGACCGGAAGAGGTACACCAGCACCAAAGAGG

TGCTGGACGCCACCCTGATCCACCAGAGCATCACCGGCCTGTACGAGACACGGATCGACCTGTC

TCAGCTGGGAGGTGAC
```

-continued

An exemplary amino acid sequence for ABE_VRQR- Cas9 (N) is set forth in SEQ ID
NO: 163:
MKRTADGSEFESPKKKRKVSEVEFSHEYWMRHALTLAKRAWDEREVPVGAVLVHNNRVIGEGWN

RPIGRHDPTAHAEIMALRQGGLVMQNYRLIDATLYVTLEPCVMCAGAMIHSRIGRVVFGARDAK

TGAAGSLMDVLHHPGMNHRVEITEGILADECAALLSDFFRMRRQEIKAQKKAQSSTDSGGSSGG

SSGSETPGTSESATPESSGGSSGGSSEVEFSHEYWMRHALTLAKRARDEREVPVGAVLVLNNRV

IGEGWNRAIGLHDPTAHAEIMALRQGGLVMQNYRLIDATLYVTFEPCVMCAGAMIHSRIGRVVF

GVRNAKTGAAGSLMDVLHYPGMNHRVEITEGILADECAALLCYFFRMPRQVFNAQKKAQSSTDS

GGSSGGSSGSETPGTSESATPESSGGSSGGSDKKYSIGLAIGTNSVGWAVITDEYKVPSKKFKV

LGNTDRHSIKKNLIGALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLENLI

AQLPGEKKNGLFGNLIALSLGLTPNFKSNFDLAEDAKLQLSKDTYDDDLDNLLAQIGDQYADLF

LAAKNLSDAILLSDILRVNTEITKAPLSASMIKRYDEHHQDLTLLKALVRQQLPEKYKEIFFDQ

SKNGYAGYIDGGASQEEFYKFIKPILEKMDGTEELLVKLNREDLLRKQRTFDNGSIPHQIHLGE

LHAILRRQEDFYPFLKDNREKIEKILTFRIPYYVGPLARGNSRFAWMTRKSEETITPWNFEEVV

DKGASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLDNE

ENEDILEDIVLTLTLFEDREMIEERLKTYAHLFDDKVMKQLKRRRYTGWGRLSRKLINGIRDKQ

SGKTILDFLKSDGFANRNFMQLIHDDSLTFKEDIQKAQVSGQGDSLHEHIANLAGSPAIKKGIL

QTVKVVDELVKVMGRHKPENIVIEMARENQTTQKGQKNSRERMKRIEEGIKELGSQILKEHPVE

NTQLQNEKLYLYYLQNGRDMYVDQELDINRLSDYDVDHIVPQSFLKDDSIDNKVLTRSDKNRGK

SDNVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAVVG

TALIKKYPKLESEFVYGDYKVYDVRKMIAKSEQEIGKATAKYFFYSNIMNFFKTEITLANGEIR

KRPLIETNGETGEIVWDKGRDFATVRKVLSMPQVNIVKKTEVQTGGFSKESILPKRNSDKLIAR

KKDWDPKKYGGFVSPTVAYSVLVVAKVEKGKSKKLKSVKELLGITIMERSSFEKNPIDFLEAKG

YKEVKKDLIIKLPKYSLFELENGRKRMLASARELQKGNELALPSKYVNFLYLASHYEKLKGSPE

DNEQKQLFVEQHKHYLDEIIEQISEFSKRVILADANLDKVLSAYNKHRDKPIREQAENIIHLFT

LTNLGAPAAFKYFDTTIDRKQYRSTKEVLDATLIHQSITGLYETRIDLSQLGGDSGGSKRT

An exemplary nucleic acid sequence encoding ABE_VRQR -Cas9 (N) is set forth in
SEQ ID NO: 164:
CTTCCGCTTCCTCGCTCACTGACTCGCTGCGCTCGGTCGTTCGGCTGCGGCGAGCGGTATCAGC

TCACTCAAAGGCGGTAATACGGTTATCCACAGAATCAGGGGATAACGCAGGAAAGAACATGTGA

GCAAAAGGCCAGCAAAAGGCCAGGAACCGTAAAAAGGCCGCGTTGCTGGCGTTTTTCCATAGGC

TCCGCCCCCCTGACGAGCATCACAAAAATCGACGCTCAAGTCAGAGGTGGCGAAACCCGACAGG

ACTATAAAGATACCAGGCGTTTCCCCCTGGAAGCTCCCTCGTGCGCTCTCCTGTTCCGACCCTG

CCGCTTACCGGATACCTGTCCGCCTTTCTCCCTTCGGGAAGCGTGGCGCTTTCTCATAGCTCAC

GCTGTAGGTATCTCAGTTCGGTGTAGGTCGTTCGCTCCAAGCTGGGCTGTGTGCACGAACCCCC

CGTTCAGCCCGACCGCTGCGCCTTATCCGGTAACTATCGTCTTGAGTCCAACCCGGTAAGACAC

GACTTATCGCCACTGGCAGCAGCCACTGGTAACAGGATTAGCAGAGCGAGGTATGTAGGCGGTG

CTACAGAGTTCTTGAAGTGGTGGCCTAACTACGGCTACACTAGAAGAACAGTATTTGGTATCTG

CGCTCTGCTGAAGCCAGTTACCTTCGGAAAAAGAGTTGGTAGCTCTTGATCCGGCAAACAAACC

-continued

```
ACCGCTGGTAGCGGTGGTTTTTTTGTTTGCAAGCAGCAGATTACGCGCAGAAAAAAAGGATCTC

AAGAAGATCCTTTGATCTTTTCTACGGGGTCTGACACTCAGTGGAACGAAAACTCACGTTAAGG

GATTTTGGTCATGAGATTATCAAAAAGGATCTTCACCTAGATCCTTTTAAATTAAAAATGAAGT

TTTAAATCAATCTAAAGTATATATGAGTAAACTTGGTCTGACAGTTACCAATGCTTAATCAGTG

AGGCACCTATCTCAGCGATCTGTCTATTTCGTTCATCCATAGTTGCCTGACTCCCCGTCGTGTA

GATAACTACGATACGGGAGGGCTTACCATCTGGCCCCAGTGCTGCAATGATACCGCGAGACCCA

CGCTCACCGGCTCCAGATTTATCAGCAATAAACCAGCCAGCCGGAAGGGCCGAGCGCAGAAGTG

GTCCTGCAACTTTATCCGCCTCCATCCAGTCTATTAATTGTTGCCGGGAAGCTAGAGTAAGTAG

TTCGCCAGTTAATAGTTTGCGCAACGTTGTTGCCATTGCTACAGGCATCGTGGTGTCACGCTCG

TCGTTTGGTATGGCTTCATTCAGCTCCGGTTCCCAACGATCAAGGCGAGTTACATGATCCCCCA

TGTTGTGCAAAAAAGCGGTTAGCTCCTTCGGTCCTCCGATCGTTGTCAGAAGTAAGTTGGCCGC

AGTGTTATCACTCATGGTTATGGCAGCACTGCATAATTCTCTTACTGTCATGCCATCCGTAAGA

TGCTTTTCTGTGACTGGTGAGTACTCAACCAAGTCATTCTGAGAATAGTGTATGCGGCGACCGA

GTTGCTCTTGCCCGGCGTCAATACGGGATAATACCGCGCCACATAGCAGAACTTTAAAAGTGCT

CATCATTGGAAAACGTTCTTCGGGGCGAAAACTCTCAAGGATCTTACCGCTGTTGAGATCCAGT

TCGATGTAACCCACTCGTGCACCCAACTGATCTTCAGCATCTTTTACTTTCACCAGCGTTTCTG

GGTGAGCAAAAACAGGAAGGCAAAATGCCGCAAAAAAGGGAATAAGGGCGACACGGAAATGTTG

AATACTCATACTCTTCCTTTTTCAATATTATTGAAGCATTTATCAGGGTTATTGTCTCATGAGC

GGATACATATTTGAATGTATTTAGAAAAATAAACAAATAGGGGTTCCGCGCACATTTCCCCGAA

AAGTGCCACCTGACGTCGACGGATCGGGAGATCGATCTCCCGATCCCCTAGGGTCGACTCTCAG

TACAATCTGCTCTGATGCCGCATAGTTAAGCCAGTATCTGCTCCCTGCTTGTGTGTTGGAGGTC

GCTGAGTAGTGCGCGAGCAAAATTTAAGCTACAACAAGGCAAGGCTTGACCGACAATTGCATGA

AGAATCTGCTTAGGGTTAGGCGTTTTGCGCTGCTTCGCGATGTACGGGCCAGATATACGCGTTG

ACATTGATTATTGACTAGTTATTAATAGTAATCAATTACGGGGTCATTAGTTCATAGCCCATAT

ATGGAGTTCCGCGTTACATAACTTACGGTAAATGGCCCGCCTGGCTGACCGCCCAACGACCCCC

GCCCATTGACGTCAATAATGACGTATGTTCCCATAGTAACGCCAATAGGGACTTTCCATTGACG

TCAATGGGTGGAGTATTTACGGTAAACTGCCCACTTGGCAGTACATCAAGTGTATCATATGCCA

AGTACGCCCCCTATTGACGTCAATGACGGTAAATGGCCCGCCTGGCATTATGCCCAGTACATGA

CCTTATGGGACTTTCCTACTTGGCAGTACATCTACGTATTAGTCATCGCTATTACCATGGTGAT

GCGGTTTTGGCAGTACATCAATGGGCGTGGATAGCGGTTTGACTCACGGGGATTTCCAAGTCTC

CACCCCATTGACGTCAATGGGAGTTTGTTTTGGCACCAAAATCAACGGGACTTTCCAAAATGTC

GTAACAACTCCGCCCCATTGACGCAAATGGGCGGTAGGCGTGTACGGTGGGAGGTCTATATAAG

CAGAGCTGGTTTAGTGAACCGTCAGATCCGCTAGAGATCCGCGGCCGCTAATACGACTCACTAT

AGGGAGAGCCGCCACCATGAAACGGACAGCCGACGGAAGCGAGTTCGAGTCACCAAAGAAGAAG

CGGAAAGTCTCTGAAGTCGAGTTTAGCCACGAGTATTGGATGAGGCACGCACTGACCCTGGCAA

AGCGAGCATGGGATGAAAGAGAAGTCCCCGTGGGCGCCGTGCTGGTGCACAACAATAGAGTGAT

CGGAGAGGGATGGAACAGGCCAATCGGCCGCCACGACCCTACCGCACACGCAGAGATCATGGCA

CTGAGGCAGGGAGGCCTGGTCATGCAGAATTACCGCCTGATCGATGCCACCCTGTATGTGACAC

TGGAGCCATGCGTGATGTGCGCAGGAGCAATGATCCACAGCAGGATCGGAAGAGTGGTGTTCGG

AGCACGGGACGCCAAGACCGGCGCAGCAGGCTCCCTGATGGATGTGCTGCACCACCCCGGCATG
```

221

222

-continued

AACCACCGGGTGGAGATCACAGAGGGAATCCTGGCAGACGAGTGCGCCGCCCTGCTGAGCGATT

TCTTTAGAATGCGGAGACAGGAGATCAAGGCCCAGAAGAAGGCACAGAGCTCCACCGACTCTGG

AGGATCTAGCGGAGGATCCTCTGGAAGCGAGACACCAGGCACAAGCGAGTCCGCCACACCAGAG

AGCTCCGGCGGCTCCTCCGGAGGATCCTCTGAGGTGGAGTTTTCCCACGAGTACTGGATGAGAC

ATGCCCTGACCCTGGCCAAGAGGGCACGCGATGAGAGGGAGGTGCCTGTGGGAGCCGTGCTGGT

GCTGAACAATAGAGTGATCGGCGAGGGCTGGAACAGAGCCATCGGCCTGCACGACCCAACAGCC

CATGCCGAAATTATGGCCCTGAGACAGGGCGGCCTGGTCATGCAGAACTACAGACTGATTGACG

CCACCCTGTACGTGACATTCGAGCCTTGCGTGATGTGCGCCGGCGCCATGATCCACTCTAGGAT

CGGCCGCGTGGTGTTTGGCGTGAGGAACGCAAAAACCGGCGCCGCAGGCTCCCTGATGGACGTG

CTGCACTACCCCGGCATGAATCACCGCGTCGAAATTACCGAGGGAATCCTGGCAGATGAATGTG

CCGCCCTGCTGTGCTATTTCTTTCGGATGCCTAGACAGGTGTTCAATGCTCAGAAGAAGGCCCA

GAGCTCCACCGACTCCGGAGGATCTAGCGGAGGCTCCTCTGGCTCTGAGACACCTGGCACAAGC

GAGAGCGCAACACCTGAAAGCAGCGGGGGCAGCAGCGGGGGGTCAGACAAGAAGTACAGCATCG

GCCTGGCCATCGGCACCAACTCTGTGGGCTGGGCCGTGATCACCGACGAGTACAAGGTGCCCAG

CAAGAAATTCAAGGTGCTGGGCAACACCGACCGGCACAGCATCAAGAAGAACCTGATCGGAGCC

CTGCTGTTCGACAGCGGCGAAACAGCCGAGGCCACCCGGCTGAAGAGAACCGCCAGAAGAAGAT

ACACCAGACGGAAGAACCGGATCTGCTATCTGCAAGAGATCTTCAGCAACGAGATGGCCAAGGT

GGACGACAGCTTCTTCCACAGACTGGAAGAGTCCTTCCTGGTGGAAGAGGATAAGAAGCACGAG

CGGCACCCCATCTTCGGCAACATCGTGGACGAGGTGGCCTACCACGAGAAGTACCCCACCATCT

ACCACCTGAGAAAGAAACTGGTGGACAGCACCGACAAGGCCGACCTGCGGCTGATCTATCTGGC

CCTGGCCCACATGATCAAGTTCCGGGGCCACTTCCTGATCGAGGGCGACCTGAACCCCGACAAC

AGCGACGTGGACAAGCTGTTCATCCAGCTGGTGCAGACCTACAACCAGCTGTTCGAGGAAAACC

CCATCAACGCCAGCGGCGTGGACGCCAAGGCCATCCTGTCTGCCAGACTGAGCAAGAGCAGACG

GCTGGAAAATCTGATCGCCCAGCTGCCCGGCGAGAAGAAGAATGGCCTGTTCGGAAACCTGATT

GCCCTGAGCCTGGGCCTGACCCCCAACTTCAAGAGCAACTTCGACCTGGCCGAGGATGCCAAAC

TGCAGCTGAGCAAGGACACCTACGACGACGACCTGGACAACCTGCTGGCCCAGATCGGCGACCA

GTACGCCGACCTGTTTCTGGCCGCCAAGAACCTGTCCGACGCCATCCTGCTGAGCGACATCCTG

AGAGTGAACACCGAGATCACCAAGGCCCCCCTGAGCGCCTCTATGATCAAGAGATACGACGAGC

ACCACCAGGACCTGACCCTGCTGAAAGCTCTCGTGCGGCAGCAGCTGCCTGAGAAGTACAAAGA

GATTTTCTTCGACCAGAGCAAGAACGGCTACGCCGGCTACATTGACGGCGGAGCCAGCCAGGAA

GAGTTCTACAAGTTCATCAAGCCCATCCTGGAAAAGATGGACGGCACCGAGGAACTGCTCGTGA

AGCTGAACAGAGAGGACCTGCTGCGGAAGCAGCGGACCTTCGACAACGGCAGCATCCCCCACCA

GATCCACCTGGGAGAGCTGCACGCCATTCTGCGGCGGCAGGAAGATTTTTACCCATTCCTGAAG

GACAACCGGGAAAAGATCGAGAAGATCCTGACCTTCCGCATCCCCTACTACGTGGGCCCTCTGG

CCAGGGGAAACAGCAGATTCGCCTGGATGACCAGAAAGAGCGAGGAAACCATCACCCCCTGGAA

CTTCGAGGAAGTGGTGGACAAGGGCGCTTCCGCCCAGAGCTTCATCGAGCGGATGACCAACTTC

GATAAGAACCTGCCCAACGAGAAGGTGCTGCCCAAGCACAGCCTGCTGTACGAGTACTTCACCG

TGTATAACGAGCTGACCAAAGTGAAATACGTGACCGAGGGAATGAGAAAGCCCGCCTTCCTGAG

CGGCGAGCAGAAAAAGGCCATCGTGGACCTGCTGTTCAAGACCAACCGGAAAGTGACCGTGAAG

CAGCTGAAAGAGGACTACTTCAAGAAAATCGAGTGCTTCGACTCCGTGGAAATCTCCGGCGTGG

AAGATCGGTTCAACGCCTCCCTGGGCACATACCACGATCTGCTGAAAATTATCAAGGACAAGGA

-continued

```
CTTCCTGGACAATGAGGAAAACGAGGACATTCTGGAAGATATCGTGCTGACCCTGACACTGTTT

GAGGACAGAGAGATGATCGAGGAACGGCTGAAAACCTATGCCCACCTGTTCGACGACAAAGTGA

TGAAGCAGCTGAAGCGGCGGAGATACACCGGCTGGGGCAGGCTGAGCCGGAAGCTGATCAACGG

CATCCGGGACAAGCAGTCCGGCAAGACAATCCTGGATTTCCTGAAGTCCGACGGCTTCGCCAAC

AGAAACTTCATGCAGCTGATCCACGACGACAGCCTGACCTTTAAAGAGGACATCCAGAAAGCCC

AGGTGTCCGGCCAGGGCGATAGCCTGCACGAGCACATTGCCAATCTGGCCGGCAGCCCCGCCAT

TAAGAAGGGCATCCTGCAGACAGTGAAGGTGGTGGACGAGCTCGTGAAAGTGATGGGCCGGCAC

AAGCCCGAGAACATCGTGATCGAAATGGCCAGAGAGAACCAGACCACCCAGAAGGGACAGAAGA

ACAGCCGCGAGAGAATGAAGCGGATCGAAGAGGGCATCAAAGAGCTGGGCAGCCAGATCCTGAA

AGAACACCCCGTGGAAAACACCCAGCTGCAGAACGAGAAGCTGTACCTGTACTACCTGCAGAAT

GGGCGGGATATGTACGTGGACCAGGAACTGGACATCAACCGGCTGTCCGACTACGATGTGGACC

ATATCGTGCCTCAGAGCTTTCTGAAGGACGACTCCATCGACAACAAGGTGCTGACCAGAAGCGA

CAAGAACCGGGGCAAGAGCGACAACGTGCCCTCCGAAGAGGTCGTGAAGAAGATGAAGAACTAC

TGGCGGCAGCTGCTGAACGCCAAGCTGATTACCCAGAGAAAGTTCGACAATCTGACCAAGGCCG

AGAGAGGCGGCCTGAGCGAACTGGATAAGGCCGGCTTCATCAAGAGACAGCTGGTGGAAACCCG

GCAGATCACAAAGCACGTGGCACAGATCCTGGACTCCCGGATGAACACTAAGTACGACGAGAAT

GACAAGCTGATCCGGGAAGTGAAAGTGATCACCCTGAAGTCCAAGCTGGTGTCCGATTTCCGGA

AGGATTTCCAGTTTTACAAAGTGCGCGAGATCAACAACTACCACCACGCCCACGACGCCTACCT

GAACGCCGTCGTGGGAACCGCCCTGATCAAAAAGTACCCTAAGCTGGAAAGCGAGTTCGTGTAC

GGCGACTACAAGGTGTACGACGTGCGGAAGATGATCGCCAAGAGCGAGCAGGAAATCGGCAAGG

CTACCGCCAAGTACTTCTTCTACAGCAACATCATGAACTTTTTCAAGACCGAGATTACCCTGGC

CAACGGCGAGATCCGGAAGCGGCCTCTGATCGAGACAAACGGCGAAACCGGGGAGATCGTGTGG

GATAAGGGCCGGGATTTTGCCACCGTGCGGAAAGTGCTGAGCATGCCCCAAGTGAATATCGTGA

AAAAGACCGAGGTGCAGACAGGCGGCTTCAGCAAAGAGTCTATCCTGCCCAAGAGGAACAGCGA

TAAGCTGATCGCCAGAAAGAAGGACTGGGACCCTAAGAAGTACGGCGGCTTCGTGAGCCCCACC

GTGGCCTATTCTGTGCTGGTGGTGGCCAAAGTGGAAAAGGGCAAGTCCAAGAAACTGAAGAGTG

TGAAAGAGCTGCTGGGGATCACCATCATGGAAAGAAGCAGCTTCGAGAAGAATCCCATCGACTT

TCTGGAAGCCAAGGGCTACAAAGAAGTGAAAAAGGACCTGATCATCAAGCTGCCTAAGTACTCC

CTGTTCGAGCTGGAAAACGGCCGGAAGAGAATGCTGGCCTCAGCCAGAGAACTGCAGAAGGGAA

ACGAACTGGCCCTGCCCTCCAAATATGTGAACTTCCTGTACCTGGCCAGCCACTATGAGAAGCT

GAAGGGCTCCCCCGAGGATAATGAGCAGAAACAGCTGTTTGTGGAACAGCACAAGCACTACCTG

GACGAGATCATCGAGCAGATCAGCGAGTTCTCCAAGAGAGTGATCCTGGCCGACGCTAATCTGG

ACAAAGTGCTGTCCGCCTACAACAAGCACCGGGATAAGCCCATCAGAGAGCAGGCCGAGAATAT

CATCCACCTGTTTACCCTGACCAATCTGGGAGCCCCTGCCGCCTTCAAGTACTTTGACACCACC

ATCGACCGGAAGCAGTACAGAAGCACCAAAGAGGTGCTGGACGCCACCCTGATCCACCAGAGCA

TCACCGGCCTGTACGAGACACGGATCGACCTGTCTCAGCTGGGAGGTGACTCTGGCGGCTCAAA

AAGAACCG
```

A nucleic acid programmable DNA binding protein (nap-DNAbp), as used herein, refers to a protein that associates with a nucleic acid (e.g., DNA or RNA), such as a guide nucleic acid, that guides the napDNAbp to a specific nucleic acid sequence. For example, a Cas9 protein can associate with a guide RNA that guides the Cas9 protein to a specific DNA sequence that has complementary to the guide RNA. In some embodiments, the napDNAbp is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), CasX, CasY, Cpf1, C2c1, C2c2, C2C3, and Argonaute. Other nucleic acid programmable DNA binding proteins are also within the scope of this disclosure, though they may not be specifically listed in this disclosure.

A Cas9 or Cas9 domain refers to an RNA-guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. Science 337:816-821 (2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase. Additional suitable nuclease-inactive dCas9 domains will be apparent to those of skill in the art based on this disclosure and knowledge in the field, and are within the scope of this disclosure.

An exemplary catalytically inactive Cas9 (dCas9):
(SEQ ID NO: 49)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDAIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

An exemplary Cas9 nickase (nCas9):
(SEQ ID NO: 50)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

-continued

```
QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD
```

A nuclease-inactivated Cas9 protein may interchangeably be referred to as a "dCas9" protein (for nuclease-"dead" Cas9). Methods for generating a Cas9 protein (or a fragment thereof) having an inactive DNA cleavage domain are known (See, e.g., Jinek et al., Science. 337:816-821(2012); Qi et al., "Repurposing CRISPR as an RNA-Guided Platform for Sequence-Specific Control of Gene Expression" (2013) Cell. 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of S. pyogenes Cas9 (Jinek et al., Science. 337:816-821(2012); Qi et al., Cell. 28; 152(5):1173-83 (2013)). In some embodiments, proteins comprising Cas9 or fragments thereof are referred to as "Cas9 variants." A Cas9 variant shares homology to Cas9, or a fragment thereof.

In some embodiments, the present disclosure provides Cas9 domains that have different PAM specificities. Typically, Cas9 proteins, such as Cas9 from S. pyogenes (spCas9), require a canonical NGG PAM sequence to bind a particular nucleic acid region, where the "N" in "NGG" is adenine (A), thymine (T), guanine (G), or cytosine (C), and the G is guanine. This may limit the ability to edit desired bases within a genome. In some embodiments, the base editing fusion proteins provided herein need to be positioned at a precise location, for example, where a target base is within a 4 base region (e.g., a "deamination window"), which is approximately 15 bases upstream of the PAM. See Komor, A. C., et al., "Programmable editing of a target base in genomic DNA without double-stranded DNA cleavage" Nature 533, 420-424 (2016), the entire contents of which are hereby incorporated by reference. In some embodiments, the deamination window is within a 2, 3, 4, 5, 6, 7, 8, 9, or 10 base region. In some embodiments, the deamination window is 5, 6, 7, 8, 9, 10, 11, 12, 13, 14, 15, 16, 17, 18, 19, 20, 21, 22, 23, 24, or 25 bases upstream of the PAM. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et al., "Broadening the targeting range of Staphylococcus aureus CRISPR-Cas9 by modifying PAM recognition" Nature Biotechnology 33, 1293-1298 (2015); the entire contents of each are hereby incorporated by reference. In some embodiments, the non-canonical PAM is NGN or NAG. In some examples, the non-canonical PAM is AGA or CAG.

A deaminase or deaminase domain refers to a protein or enzyme that catalyzes a deamination reaction. In some embodiments, the deaminase is an adenosine deaminase, which catalyzes the hydrolytic deamination of adenine or adenosine. In some embodiments, the deaminase or deaminase domain is an adenosine deaminase, catalyzing the hydrolytic deamination of adenosine or deoxyadenosine to inosine or deoxyinosine, respectively. In some embodiments, the adenosine deaminase catalyzes the hydrolytic deamination of adenine or adenosine in deoxyribonucleic acid (DNA). The adenosine deaminases (e.g. engineered adenosine deaminases, evolved adenosine deaminases) provided herein may be from any organism, such as a bacterium. In some embodiments, the deaminase or deaminase domain is a variant of a naturally-occurring deaminase from an organism. In some embodiments, the deaminase or deaminase domain does not occur in nature. In some embodiments, the adenosine deaminase is from a bacterium, such as, E. coli, S. aureus, Bacillus subtilis, G. sulfurreducens, S. typhi, S. putrefaciens, H. influenzae, or C. crescentus. In some embodiments, the adenosine deaminase is a TadA deaminase. In some embodiments, the TadA deaminase is an E. coli TadA deaminase (ecTadA).

In some embodiments, the TadA deaminase is a full-length E. coli TadA deaminase. For example, in certain embodiments, the adenosine deaminase comprises the amino acid sequence:

```
                                  (SEQ ID NO: 52)
MRRAFITGVFFLSEVEFSHEYWMRHALTLAKRAWDEREVPVGAVLVHNNR

VIGEGWNRPIGRHDPTAHAEIMALRQGGLVMQNYRLIDATLYVTLEPCVM

CAGAMIHSRIGRVVFGARDAKTGAAGSLMDVLHHPGMNHRVEITEGILAD

ECAALLSDFFRMRRQEIKAQKKAQSSTD
```

A linker, as used herein, refers to a bond (e.g., covalent bond), chemical group, or a molecule linking two molecules or moieties, e.g., two domains of a fusion protein, such as, for example, a nuclease-inactive Cas9 domain and a nucleic acid-editing domain (e.g., an adenosine deaminase). In some embodiments, a linker joins a gRNA binding domain of an RNA-programmable nuclease, including a Cas9 nuclease domain, and the catalytic domain of a nucleic-acid editing protein. In some embodiments, a linker joins a dCas9 and a nucleic-acid editing protein. Typically, the linker is posi- In other examples, the point mutation is selected from the point mutations in Table 1. Non-limiting exemplary guide RNA sequence are set forth in Table 4:

| Guide | Editor | Sequence | PAM | SEQ ID NO |
|---|---|---|---|---|
| Guide 1 | ABE7, max, 8e | TTCACCTCTCATTCAGATTT | TGG | 51 |
| Guide 1 (−2) | ABE7, max, 8e | CACCTCTCATTCAGATTT | TGG | 165 |
| Guide 1 (−1) | ABE7, max, 8e | TCACCTCTCATTCAGATTT | TGG | 166 |
| Guide ALT | ABE7, max, 8e | GTGGTGGTTCACCTCTCATT | CAG | 167 |
| Guide 1 (+1) | ABE7, max, 8e | GTTCACCTCTCATTCAGATTT | TGG | 168 |
| Guide 1 (+2) | ABE7, max, 8e | GGTTCACCTCTCATTCAGATT | TGG | 169 |
| Guide 1 (+3) | ABE7, max, 8e | TGGTTCACCTCTCATTCAGATTT | TGG | 170 |
| Guide 2 | ABE7, max, 8e | TCACCTCTCATTCAGATTTT | GGG | 171 |
| Guide 3 | ABEvrqr | TGGTGGTTCACCTCTCATTC | AGA | 172 | tioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

Some aspects of this disclosure provide complexes comprising any of the fusion proteins provided herein, and a guide nucleic acid bound to napDNAbp of the fusion protein. Some aspects of this disclosure provide complexes comprising any of the fusion proteins provided herein, and a guide RNA bound to a Cas9 domain (e.g., a dCas9, a nuclease active Cas9, or a Cas9 nickase) of fusion protein.

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is an RNA sequence. In some embodiments, the target sequence is a sequence in the genome of a mammal. In some embodiments, the target sequence is a sequence in the genome of a human. In some embodiments, the 3' end of the target sequence is immediately adjacent to a canonical PAM sequence (NGG). In some embodiments, the guide nucleic acid (e.g., guide RNA) is complementary to a sequence associated with a disease or disorder (e.g., Usher Syndrome type 1F). In some embodiments, the guide nucleic acid (e.g., guide RNA) is complementary to a sequence associated with a disease or disorder having a mutation in a gene (e.g., PCDH15). In some embodiments, the mutation in PCDH15 is a point mutation.

In other embodiments, the guide RNA comprises a nucleic acid sequence at least 60%, 70%, 75%, 80%, 85%, 90%, 01%, 92%, 93%, 94%, 95%, 96%, 97%, 98%, 99% or 100% identical to nucleic acid sequence of SEQ ID NO: 51, and 165-172. The gRNA sequences provided herein are sequences that encode RNA that can direct Cas9, or any of the base editors provided herein, to a target site. For example, the gRNA sequences provided herein may be cloned into a gRNA expression vector, such as pFYF to encode a gRNA that targets Cas9, or any of the base editors provided herein, to a target site in order to correct a disease-related mutation. It should be appreciated, however, that additional mutations may be corrected to treat additional diseases associated with a G to A or C to T mutation. Furthermore, additional gRNAs may be designed based on the disclosure and the knowledge in the art, which would be appreciated by the skilled artisan.

In some embodiments, the purpose of the methods provided herein is to restore the function of a dysfunctional gene (e.g., PCDH15) via genome editing. The nucleobase editing proteins provided herein can be validated for gene editing-based human therapeutics in vitro, e.g., by correcting a disease-associated mutation in human cell culture. It will be understood by the skilled artisan that the nucleobase editing proteins provided herein, e.g., the base editor comprising a nucleic acid programmable DNA binding protein (e.g., Cas9) and an adenosine deaminase domain can be used to correct any single point G to A or C to T mutation. In some embodiments deamination of the A that is base-paired with the mutant T, followed by a round of replication, corrects the mutation. Exemplary point mutations that can be corrected are listed in Tables 1.

The successful correction of point mutations in disease-associated genes and alleles opens up new strategies for gene correction with applications in therapeutics and basic research for diseases (e.g., somatic recessive congenital diseases such as Usher Syndrome type 1F). Site-specific single-base modification systems like the disclosed fusions of a nucleic acid programmable DNA binding protein and an adenosine deaminase domain can be used to restore protein function in vitro, ex vivo, or in vivo.

The instant disclosure provides methods for the treatment of a subject diagnosed with a disease (e.g., Usher Syndrome type 1F) associated with or caused by a point mutation of a gene (e.g., c. C733>T in PCDH15) that can be corrected by a DNA editing fusion protein provided herein. For example, in some embodiments, a method is provided that comprises administering to a subject having such a disease, e.g., Usher Syndrome type 1F, an effective amount of an adenosine deaminase fusion protein that corrects the point mutation or introduces a deactivating mutation into a disease-associated gene.

V. Kits and Related Composition

The agents described herein may, in some embodiments, be assembled into pharmaceutical or diagnostic or research kits to facilitate their use in therapeutic, diagnostic or research applications. A kit may include one or more containers housing the components of the disclosure and instructions for use. Specifically, such kits may include one or more agents described herein, along with instructions describing the intended application and the proper use of these agents. In certain embodiments agents in a kit may be in a pharmaceutical formulation and dosage suitable for a particular application and for a method of administration of the agents. Kits for research purposes may contain the components in appropriate concentrations or quantities for running various experiments.

In some embodiments, the instant disclosure relates to a kit for producing a rAAV, the kit comprising a container housing an isolated nucleic acid comprising a transgene encoding a protein (e.g., mini-PCDH15) having the amino acid sequence set forth in SEQ ID NO: 31, 33, 35, 37, 39, 41, 43, or 45. In some embodiments, the kit further comprises a container housing an isolated nucleic acid encoding an AAV capsid protein, for example, an AAV.PHP.B capsid protein (e.g., SEQ ID NO: 47).

In some embodiments, the instant disclosure relates to a kit for treating hearing loss and/or blindness. In some embodiments, the kit is for delivering a functional protein (e.g., mini-PCDH15) to a target cell (e.g., inner hair cell, out hair cell or photoreceptor) using gene therapy (e.g., rAAV described herein). In other embodiments, the kit is for correcting a mutation in a disease related gene (e.g., c.722C>T in PCDH15 gene in Usher Syndrome type 1F) using a base editor described herein.

The kit may be designed to facilitate use of the methods described herein by researchers and can take many forms. Each of the compositions of the kit, where applicable, may be provided in liquid form (e.g., in solution), or in solid form, (e.g., a dry powder). In certain cases, some of the compositions may be constitutable or otherwise processable (e.g., to an active form), for example, by the addition of a suitable solvent or other species (for example, water or a cell culture medium), which may or may not be provided with the kit. As used herein, "instructions" can define a component of instruction and/or promotion, and typically involve written instructions on or associated with packaging of the disclosure. Instructions also can include any oral or electronic instructions provided in any manner such that a user will clearly recognize that the instructions are to be associated with the kit, for example, audiovisual (e.g., videotape, DVD, etc.), Internet, and/or web-based communications, etc. The written instructions may be in a form prescribed by a governmental agency regulating the manufacture, use or sale of pharmaceuticals or biological products, which instructions can also reflects approval by the agency of manufacture, use or sale for animal administration.

The kit may contain any one or more of the components described herein in one or more containers. As an example, in one embodiment, the kit may include instructions for mixing one or more components of the kit and/or isolating and mixing a sample and applying to a subject. The kit may include a container housing agents described herein. The agents may be in the form of a liquid, gel or solid (powder). The agents may be prepared sterilely, packaged in syringe and shipped refrigerated. Alternatively it may be housed in a vial or other container for storage. A second container may have other agents prepared sterilely. Alternatively the kit may include the active agents premixed and shipped in a syringe, vial, tube, or other container.

Exemplary embodiments of the invention will be described in more detail by the following examples. These embodiments are exemplary of the invention, which one skilled in the art will recognize is not limited to the exemplary embodiments.

VI. General Techniques

The practice of the present invention will employ, unless otherwise indicated, conventional techniques of molecular biology (including recombinant techniques), microbiology, cell biology, biochemistry and immunology, which are within the skill of the art. Molecular Cloning: A Laboratory Manual, second edition (Sambrook, et al., 1989) Cold Spring Harbor Press; Oligonucleotide Synthesis (M. J. Gait, ed., 1984); Methods in Molecular Biology, Humana Press; Cell Biology: A Laboratory Notebook (J. E. Cellis, ed., 1998) Academic Press; Animal Cell Culture (R. I. Freshney, ed., 1987); Introduction to Cell and Tissue Culture (J. P. Mather and P. E. Roberts, 1998) Plenum Press; Cell and Tissue Culture: Laboratory Procedures (A. Doyle, J. B. Griffiths, and D. G. Newell, eds., 1993-8) J. Wiley and Sons; Methods in Enzymology (Academic Press, Inc.); Handbook of Experimental Immunology (D. M. Weir and C. C. Blackwell, eds.); Gene Transfer Vectors for Mammalian Cells (J. M. Miller and M. P. Calos, eds., 1987); Current Protocols in Molecular Biology (F. M. Ausubel, et al., eds., 1987); PCR: The Polymerase Chain Reaction, (Mullis, et al., eds., 1994); Current Protocols in Immunology (J. E. Coligan et al., eds., 1991); Short Protocols in Molecular Biology (Wiley and Sons, 1999); Immunobiology (C. A. Janeway and P. Travers, 1997); Antibodies (P. Finch, 1997); Antibodies: a practical approach (D. Catty., ed., IRL Press, 1988-1989); Monoclonal antibodies: a practical approach (P. Shepherd and C. Dean, eds., Oxford University Press, 2000); Using antibodies: a laboratory manual (E. Harlow and D. Lane (Cold Spring Harbor Laboratory Press, 1999); The Antibodies (M. Zanetti and J. D. Capra, eds., Harwood Academic Publishers, 1995). Without further elaboration, it is believed that one skilled in the art can, based on the above description, utilize the present invention to its fullest extent. The following specific embodiments are, therefore, to be construed as merely illustrative, and not limitative of the remainder of the disclosure in any way whatsoever. All publications cited herein are incorporated by reference for the purposes or subject matter referenced herein.

Without further elaboration, it is believed that one skilled in the art can, based on the above description, utilize the present invention to its fullest extent. The following specific embodiments are, therefore, to be construed as merely illustrative, and not limitative of the remainder of the disclosure in any way whatsoever. All publications cited herein are incorporated by reference for the purposes or subject matter referenced herein.

EXAMPLES

Figure 1B:
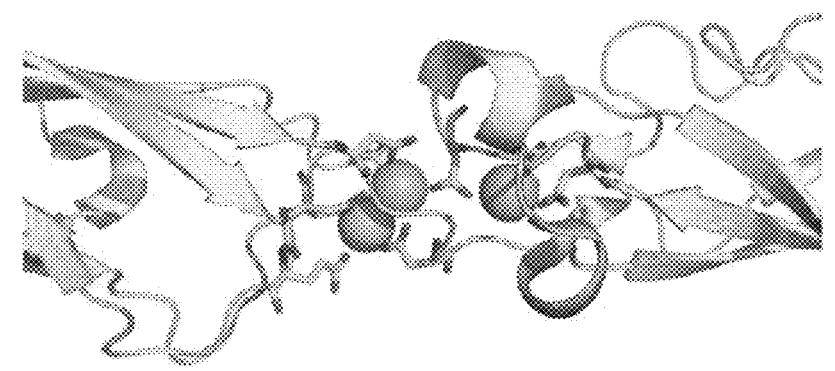
FIG. 1B shows strategy for constructing mini-PCDH15 proteins. Top panel shows atomic structure of the junction between two EC domains in PCDH15, showing calcium ions and the side chains of calcium-binding residues. The structure of PCDH15 is well understood, enabling precise deletion of EC domains with splicing that preserves calcium binding. Middle panel shows X-ray crystal structure of the entire extracellular domain of PCDH15, solved by Sotomayor and colleagues. EC1-3 and possibly EC9-10 are involved in cis dimerization. Bottom panel shows map of deleted segments for the first eight constructs.
Figure 1B:
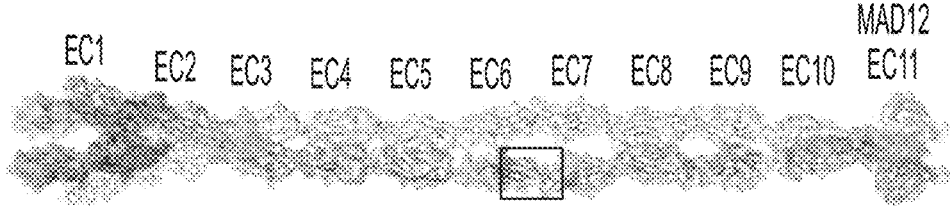
Figure 1B:
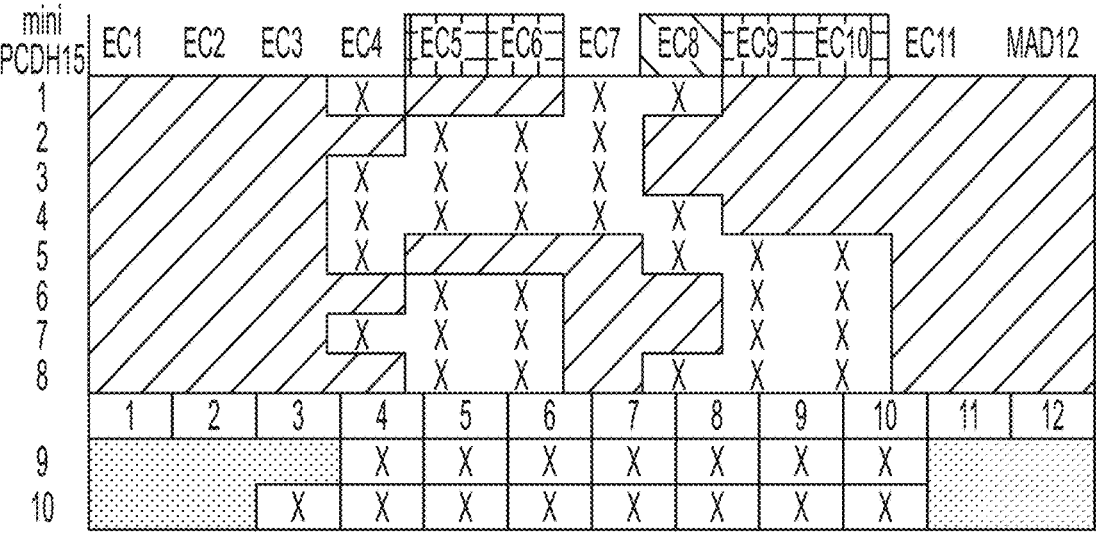
Figure 1C:
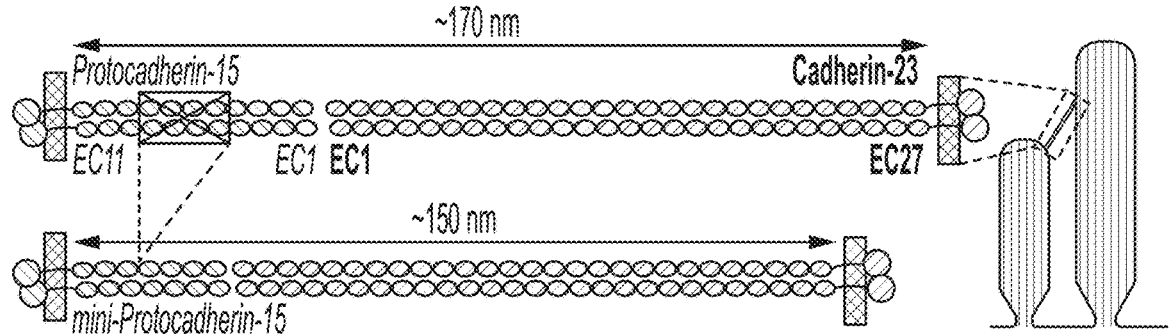
FIG. 1C is an illustration of deletion of EC domains that results in a shorter PCDH15.
Figure 1D:
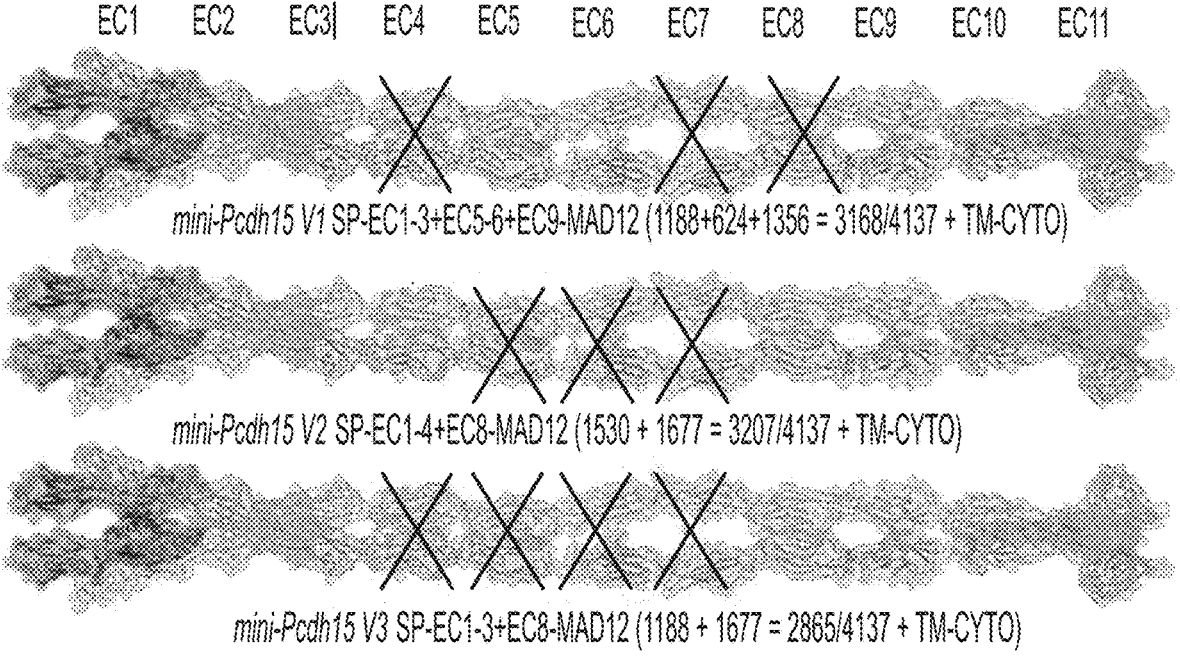
FIG. 1D-1F show illustrations of 8 mini-PCDH15 constructs.
Figure 1E:
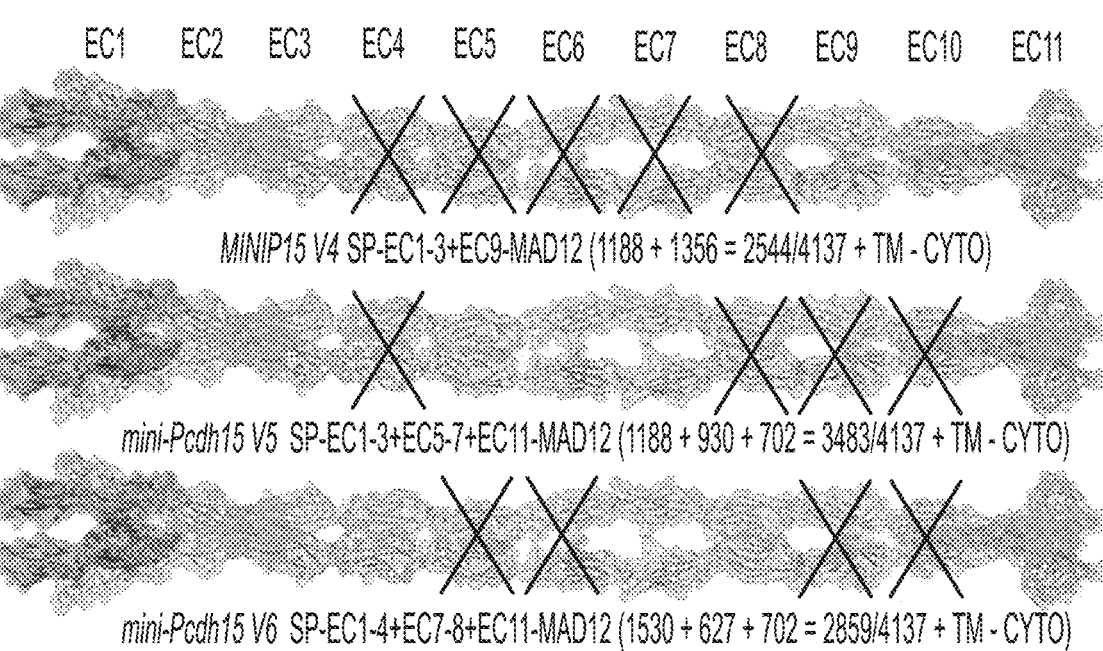
Figure 1F:
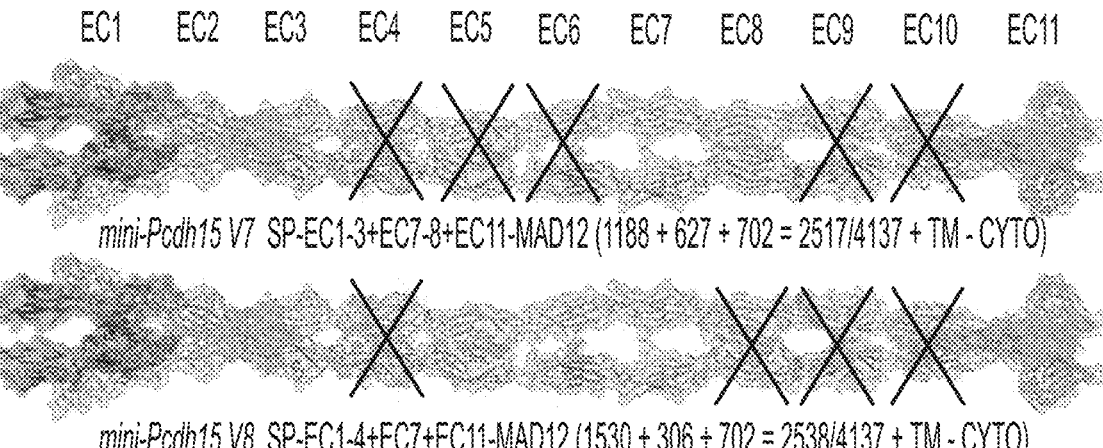

Example 1: Mini-PCDH15 Proteins Encoded by a Single AAV Genome for Rescue of Hair Cell Function In hair cells, the PCDH15 protein forms the 'tip link' between stereocilia (Kazmierczak et al., 2007), pulling directly on ion channels to initiate the electrical response to sound (FIG. 1A). PCDH15 is a large protein of up to 1955 amino acids, forming 11 link-like 'extracellular cadherin' (EC) repeats and a transmembrane domain (Ahmed et al., 2001; Ge et al., 2018). The X-ray crystal structure of the PCDH15 extracellular domain has been solved by our collaborator Marcos Sotomayor (Sotomayor et al., 2012; Araya-Secchi et al., 2016; Powers et al., 2017; Narui and Sotomayor, 2018; De-la-Torre et al., 2018).

miniPCDH15 constructs based on a number of considerations: structure of full-length hsPCDH15; non-canonical linkers at EC5-6, EC9-10 and EC8-9; retention of EC1-3 for interactions with CDH23 (EC1-2) and parallel dimerization (EC2-3); retention of EC11-MAD12 for parallel dimerization and interactions with transmembrane proteins. Accordingly eight versions of msPCDH15 with 3-5 EC domain deletions were generated. Each expression vector includes miniPCDH15-IRES-GFP such that GFP expression can be used for detection. (FIG. 1B). Each miniPCDH15 coding sequence encodes CD2 splice form of PCDH15, which is necessary for hair-cell function. The deletion of 3-5 EC domains from PCDH15 coding sequence decreased the size of the coding sequence from ~5400 bp to 3750-4400 bp, rendering it amenable to be packaged into a single AAV vector (FIG. 1C). Both mouse mini-PCDH15 and human mini-PCDH15 were designed such that V1 lacks EC4, EC7 and EC8 domains; V2 lacks EC5, EC6 and EC7 domains; V3 lacks EC4, EC5, EC6 and EC7 domains; V4 lacks EC4, EC5, EC6, EC7, and EC8; V5 lacks EC4, EC8, EC9, and EC10; V6 lacks EC5, EC6, EC9, and EC10; V7 lacks EC4, EC5, EC6, EC9, and EC10; and V8 lacks EC5, EC6, EC8, EC9, and EC10 (FIGS. 1D-1F). One skilled in the art would readily understood that these exemplary mini-PCDH15s are not meant to be limiting and other mini-PCDH15s can be designed by deletion of different EC domains.

Human mini-PCDH15 amino acid sequences and nucleic acid coding sequences are set forth as follows: V1 (SEQ ID NO: 31 and SEQ ID NO: 32; SEQ ID NO: 75 and SEQ ID NO: 77; SEQ ID NO: 76 and SEQ ID NO: 78); V2 (SEQ ID NO: 33 and SEQ ID NO: 34; SEQ ID NO: 79 and SEQ ID NO: 81; SEQ ID NO: 80 and SEQ ID NO: 82); V3 (SEQ ID NO: 35 and SEQ ID NO: 36; SEQ ID NO: 83 and SEQ ID NO: 85; SEQ ID NO: 84 and SEQ ID NO: 86); V4 (SEQ ID NO: 41 and SEQ ID NO: 42; SEQ ID NO: 95 and SEQ ID NO: 97; SEQ ID NO: 96 and SEQ ID NO: 98); V5 (SEQ ID NO: 37 and SEQ ID NO: 38; SEQ ID NO: 87 and SEQ ID NO: 89; SEQ ID NO: 88 and SEQ ID NO: 90); V6 (SEQ ID NO: 39 and SEQ ID NO: 40; SEQ ID NO: 91 and SEQ ID NO: 93; SEQ ID NO: 92 and SEQ ID NO: 94); V7 (SEQ ID NO: 43 and SEQ ID NO: 44; SEQ ID NO: 99 and SEQ ID NO: 101; SEQ ID NO: 100 and SEQ ID NO: 102); V8 (SEQ ID NO: 45 and SEQ ID NO: 46; SEQ ID NO: 103 and SEQ ID NO: 105; SEQ ID NO: 104 and SEQ ID NO: 106), V9 (SEQ ID NO: 71 and SEQ ID NO: 72; SEQ ID NO: 107 and SEQ ID NO: 109; SEQ ID NO: 108 and SEQ ID NO: 110) and V10 (SEQ ID NO: 73 and SEQ ID NO: 74; SEQ ID NO: 111 and SEQ ID NO: 113; SEQ ID NO: 112 and SEQ ID NO: 114).

Mouse Mini-PCDH15 Coding Sequences are as Follows:

```
Mouse mini-PCDH15-CD2-1-V1
                                                          (SEQ ID NO: 150)
AAGGGCTGTGTTGTAACCTTCGGAGTTTGCGCCTGGAGATTTCTTGGGCTCTTCATCCTTCCTT

CTGTCATATTCTGGCACCTGAAAGCCCCAGGGGCCTCCGGAGAGACTCTCACTGGTACTGCTGC

TGCTGCTCAGTTCTGACTCTGACTCCTCACTTTCCACGCCCCTCTCCATGGAGACTGATTCTGC

ACTGCCCTCCTCTGGGACATCCTGAGCCTCCAGGTCTGTGGACTCATCCATGGGAGCTGCTTCG

CTTTCTTCTCCTTCCTCTGCCCGTTCTTCCTCCTCTAGTGGGGGCTCTTCTTCCTCTTCCACCG

GGGGCTCCTCTCTCTTACCTTTCACCTCCTGGATTTCCTCGACCACAGGCCTTCTTCTAGCCAG

CACGATGTTTTTTCTTGCTTTCTCTCCCTCTGACTCAGTGGACTCAGACTCCTCTGACTCCGGG

GTAGAGCTCTCCTCCGCTTCCTCAGATGGGGTCTCCGACTCTGATTCTTCAGTTGTCTCGGACT

CGCTGAACTCGGACTCCGTTTCTGTGTATTCTGTGTAGTCGCTGGACTCCTCCTCTGACTCCAC

GGTGCTTTCGGTAGCTTCCTCCTGGTCTAGAGTCAGTTGAAGATAGTCTTTGTCTTCTTCATCA

AGGCGCCTCCTCCACTCCTCGCCCTCAAGGTCAATGCCTCTTTTCTCAGCGAGACCTCTGACTT

TCTTAAAAATCATCGGGAATATCCTGGCTCTCTTCCACGTTGGGTATGTGGGCTCAGCCGCTGG

TGGCTTCTCAACGGTGACTACCACCTCCTCCTCACTAGGCTCTCTAATTTCAACTTTGGGTTTT

TTAACTTTCTCTGGCTCTACCTCTTCTTCTTCATATTCCTCTTCAGCTTCACCAATGACTTCGC

CGTATTCCTCCTGTCCAGCAGGTGGCAGCAGTCGACGGCGACTTCCATACTGGGGCATCTCATA

CTTATGCATTGCGCTCTCTCCCAGTTCTTCATAGAGATGTGCTCCTGGTGGTGGTGGTGGCGGG

GGCGGGGGCGGCGCAGGCGCAGCTGGTACAGGAGCTGCAGGCTTGGCTGCAGGCATAGCAGACT
```

GAATTCTTGCGGTCTTCGTGCACTCAGCCTGGCGTACTTTAAACTGTCGGTAGCTTACTAAGAC

GACCAAGATGGCTGGGATGCAACAGAGGATGATGATGAAGGCCAAGGCCAGCAAGGCCCCTTCT

GTGTACCCCAAGCTTTCTCCTCGCTTCTTGATGCTCGTCACTGCCTCAGGTGTCCGAATCTCCA

GAATGCGCCCTCCTTCCCCGTAATACGGCTGGAAGTCTTTATTGATATCGAGCAGTTTGCCGTC

CAGGAACTTAAAAAGCTCATTTCTGTCGATGGCTCTGTTGGTCTGCGGGTCGATGGCATAGACA

GTCAGGTCGCACTTGCTATAGTCTTCTAGGGAGTAGGCGTCTCCATGGCGACGGGCACCTATGG

ACTCCACCACAACCTTGGCACCAGGAATTTGCTCCTGAACGTAGCGATCCAAAATCTCTGTAAG

GTCTTCTATCTTCTTTTCCACTAGTGTAGGGGGCACATTGGAGACAATGACCTGCATATCCAGT

TGATTGACCACGGAGACCAGTACGTCTGCTTTCCCGCTCAACCCCTTCCCGTAGTCGTCAGTTG

CAATCACTTGAAACTTGAAGTAGGATCTTCTCATATTGTGGAAGAGCATGGCTGTCTTGATGAG

ACCTGTGTATGTTTCCACCACAAACCCCTCTTTGCCCTCTTTAATCGGCGGTATGATGAGCCGG

TAGGCCATGGCACTGTAATTACCCGTGTCCCTGTCGGTGGCCTTCACTCTGAGCACAGATGCGA

ACATCCTTGCGTCTTCAGACACACCTCCAATGTAGAATTTCTTCTGGAACACTGGGGGGTGATC

GTTTTCATCCTGAATCTCAATGTACACCTTAGCTGTATTGCTTTTTGAAGGGACTCGGAGATTG

GCAAGGACCACTTCCAGAGAATCTGCTTGTACCCGGAGCACATAGCTGGTCCTTGTCTCGTAAT

CCAATGGTGAATTCACATAGATGACCCCAGTGACATTGTTGATTCCAAACTTGTCTTCCTCATT

TCCTGCCACAATGGAGTACACGATGCTCTGATTAATGGCAGCAGCAGAAATGACACCAACTACA

GTCCCTCTGGCCGCAAGCTCACTTACAGGAGGAGGTCTGTATTCCTCTTGGGTGAAGCGTGGGA

TCTCTCCAGGATGTAAGACAAGAATTCTCACCGTGGCACTGCTGGACATCACAGGTTCGCCGTC

ATCAAAAGCCACAACCACCAGCTTGAAAATCGTAGTAGGCTCTTCATTAAGATTGACGCGGGTT

ACTACTCTTCCAGAATCTTCCTCTACATCAAAAATACTGGCTGGGTATGGAAACTGCACGTCGT

CCACTCGATACCTCACCCTACTTGCAGGCATCCCAGGTGGGTCCGCATCTTCAGCATAAACGGT

GGTGATTGGTGTCCCCTTGACTGCATCTGGAGCCACCATCCCCTTGTAGATGCGTTTGCTAAAC

ACTGGAGGGTTGTCATTGACGTCCGTCACCACTATGTTCACAGTGGCAGTTGAGGTTCCATCCG

GTCTGCCATCTGAGGCTGTGACGATGAGGATGTAGCGGTCTGTGCTCTCGCGGTCTAGAGCCTT

CCCTAGGCTGAGAATCCCTGTGGTTTCTGAAAGATTAAAAACTCTCTGAGGGTCTCCATTCTCG

ATGGCATATGTGATTGGATCTCCCTCTCGATCAGTTGCCTGTAGATTTAATAAAATAGCACCGA

TCCTCATGGCCTCGCTGACTTCCAGACTGTACATCAGCTGCGGGAAGCGGGGAGGGCTCTGGTT

GTTAGGAGGAAGCACCTCGATGTACACTGTGCAGATGGAGTGCCTTCTTTCTGCAGGCGGGGCG

TTGTCCGAAGCCTGCACTGTGAGCGCATACGTCTGTCCCACGATCAGCTCCACGCCTGGTGCAA

TGCTCACCAGCCCTGTGGTCTTGTTGATCACGAAGTCTCCCTTGCCCCCCACCAGTATTTCATA

GGAGATCTCCCCATTAGAGCCTTCATCAGCATCTACCGCTGTCAGCTGAATGACGCTGTCCCCA

GGACTCATGTCTGTGTAAACATAGACATCATAGGAGATTTCAGGGAAGGTGGGCGTCTGATTGT

TTTCGTCTAGTATTTCGATGTGCAGACTAGCAAAGGCAGGAAGTGGGTGGCCATTGTCCTGCTC

AGCCTTAATAACCAAATCAAATTTTTGATGGAAGTCTCTGTTTACTGGCTCCAGGAGAGTGAGT

TCTGCAGTCCTGGGATGCATATGGAAGAAGCGGGGGTAATCCTCAGGGGTGCCGACAAGGATGG

AGTAGAGGATGCCAGGTCGATCAGATGGTGGTTGGATGTTTCGGTCCTGATCAATGGCTTGGAT

AGGTGGTGTCACCAAAATAGGGTTCAGTTCTTCCGGAGTCCTCAGTTCAGGAATGGCAGCTTGG

TAGGTGAGTGGACGACAGTCACGTGTGTTTGGCACAAGAACACAAGGCAGAAACATAGGTCCCA

GGTCATCTCCATCTAGAACATCTACTGTGAGGGTGGTGGTGGTTGTTCGCCTCTCATTCAGATT

TTGTGCACGGTCATTTGCTTGGATGATGACATAGTAGCGAGTCTTATCCTCATAGTTGAGTCTT

-continued

TTCCTCAGTACCACGTTGCCAGTCAGCATGAGTGGAATTTCAAAGGTGTCGTTGGATGTCGGAT

CTTCTGGGTTGTACTGAATCACGTATTCTATCTGTCCATTAGGGCCATCGTCTATGTCTGTAGC

TCCATTGTCTCCCGAGAACCCCGTGAATATCGTGGTGCCAACTGGAGTGAGCTCATTCACGGTG

GCATAGTAGCTTTCATGCTTGAATGTGGGGGAGTTGTCATTCCGATCTCGCACCACGATGCGTA

CTTCATGATAGATAACTGTGCCAACCTTCTTGTTGACACACTGGACTTGCACCACAATGGAGTG

TATGTTCATTGGTGGGTCTCTATCCAGAACTCTTCCGGTACTGTTCAGGAAAAGCATCTGTTTA

ACGGGGTCCAGCAACACCCAGTAGTCCACGTTGTCCTTTAAAGAGAGCTCTATGGTGGGGTCTG

GTCCTCCGGCAGTCCCCTTAATCAACATGTTATCCACCAGAATTGTACCGTTTCGACTCTCTTC

ATCAATGGCCACGATAGTAGCTGGTGGTCCTCCCCTAGCTAGTTTGCAATCCTCGTATTGCCAG

TCATCGTCATACTGGCCCCAGCTGACTACCAAGAGAGAGGCAATGAGGATCCCATGGGGTAAAC

ACTTCCAGACAGCAAACTGTAGGAACAT

Mouse mini-PCDH15-CD2-1-V2

(SEQ ID NO: 151)

AAGGGCTGTGTTGTAACCTTCGGAGTTTGCGCCTGGAGATTTCTTGGGCTCTTCATCCTTCCTT

CTGTCATATTCTGGCACCTGAAAGCCCCAGGGGCCTCCGGAGAGACTCTCACTGGTACTGCTGC

TGCTGCTCAGTTCTGACTCTGACTCCTCACTTTCCACGCCCCTCTCCATGGAGACTGATTCTGC

ACTGCCCTCCTCTGGGACATCCTGAGCCTCCAGGTCTGTGGACTCATCCATGGGAGCTGCTTCG

CTTTCTTCTCCTTCCTCTGCCCGTTCTTCCTCCTCTAGTGGGGGCTCTTCTTCCTCTTCCACCG

GGGGCTCCTCTCTCTTACCTTTCACCTCCTGGATTTCCTCGACCACAGGCCTTCTTCTAGCCAG

CACGATGTTTTTTCTTGCTTTCTCTCCCTCTGACTCAGTGGACTCAGACTCCTCTGACTCCGGG

GTAGAGCTCTCCTCCGCTTCCTCAGATGGGGTCTCCGACTCTGATTCTTCAGTTGTCTCGGACT

CGCTGAACTCGGACTCCGTTTCTGTGTATTCTGTGTAGTCGCTGGACTCCTCCTCTGACTCCAC

GGTGCTTTCGGTAGCTTCCTCCTGGTCTAGAGTCAGTTGAAGATAGTCTTTGTCTTCTTCATCA

AGGCGCCTCCTCCACTCCTCGCCCTCAAGGTCAATGCCTCTTTTCTCAGCGAGACCTCTGACTT

TCTTAAAAATCATCGGGAATATCCTGGCTCTCTTCCACGTTGGGTATGTGGGCTCAGCCGCTGG

TGGCTTCTCAACGGTGACTACCACCTCCTCCTCACTAGGCTCTCTAATTTCAACTTTGGGTTTT

TTAACTTTCTCTGGCTCTACCTCTTCTTCTTCATATTCCTCTTCAGCTTCACCAATGACTTCGC

CGTATTCCTCCTGTCCAGCAGGTGGCAGCAGTCGACGGCGACTTCCATACTGGGGCATCTCATA

CTTATGCATTGCGCTCTCTCCCAGTTCTTCATAGAGATGTGCTCCTGGTGGTGGTGGTGGCGGG

GGCGGGGGCGGCGCAGGCGCAGCTGGTACAGGAGCTGCAGGCTTGGCTGCAGGCATAGCAGACT

GAATTCTTGCGGTCTTCGTGCACTCAGCCTGGCGTACTTTAAACTGTCGGTAGCTTACTAAGAC

GACCAAGATGGCTGGGATGCAACAGAGGATGATGATGAAGGCCAAGGCCAGCAAGGCCCCTTCT

GTGTACCCCAAGCTTTCTCCTCGCTTCTTGATGCTCGTCACTGCCTCAGGTGTCCGAATCTCCA

GAATGCGCCCTCCTTCCCCGTAATACGGCTGGAAGTCTTTATTGATATCGAGCAGTTTGCCGTC

CAGGAACTTAAAAAGCTCATTTCTGTCGATGGCTCTGTTGGTCTGCGGGTCGATGGCATAGACA

GTCAGGTCGCACTTGCTATAGTCTTCTAGGGAGTAGGCGTCTCCATGGCGACGGGCACCTATGG

ACTCCACCACAACCTTGGCACCAGGAATTTGCTCCTGAACGTAGCGATCCAAAATCTCTGTAAG

GTCTTCTATCTTCTTTTTCCACTAGTGTAGGGGGCACATTGGAGACAATGACCTGCATATCCAGT

TGATTGACCACGGAGACCAGTACGTCTGCTTTCCCGCTCAACCCCTTCCCGTAGTCGTCAGTTG

CAATCACTTGAAACTTGAAGTAGGATCTTCTCATATTGTGGAAGAGCATGGCTGTCTTGATGAG

ACCTGTGTATGTTTCCACCACAAACCCCTCTTTGCCCTCTTTAATCGGCGGTATGATGAGCCGG

-continued

```
TAGGCCATGGCACTGTAATTACCCGTGTCCCTGTCGGTGGCCTTCACTCTGAGCACAGATGCGA

ACATCCTTGCGTCTTCAGACACACCTCCAATGTAGAATTTCTTCTGGAACACTGGGGGGTGATC

GTTTTCATCCTGAATCTCAATGTACACCTTAGCTGTATTGCTTTTTGAAGGGACTCGGAGATTG

GCAAGGACCACTTCCAGAGAATCTGCTTGTACCCGGAGCACATAGCTGGTCCTTGTCTCGTAAT

CCAATGGTGAATTCACATAGATGACCCCAGTGACATTGTTGATTCCAAACTTGTCTTCCTCATT

TCCTGCCACAATGGAGTACACGATGCTCTGATTAATGGCAGCAGCAGAAATGACACCAACTACA

GTCCCTCTGGCCGCAAGCTCACTTACAGGAGGAGGTCTGTATTCCTCTTGGGTGAAGCGTGGGA

TCTCTCCAGGATGTAAGACAAGAATTCTCACCGTGGCACTGCTGGACATCACAGGTTCGCCGTC

ATCAAAAGCCACAACCACCAGCTTGAAAATCGTAGTAGGCTCTTCATTAAGATTGACGCGGGTT

ACTACTCTTCCAGAATCTTCCTCTACATCAAAAATACTGGCTGGGTATGGAAACTGCACGTCGT

CCACTCGATACCTCACCCTACTTGCAGGCATCCCAGGTGGGTCCGCATCTTCAGCATAAACGGT

GGTGATTGGTGTCCCCTTGACTGCATCTGGAGCCACCATCCCCTTGTAGATGCGTTTGCTAAAC

ACTGGAGGGTAGTCATTCATGTCCTTCACAATTACCGTGACTGTTGCTATACCAGGTGGCATAG

TCCCATAAATGTCAAAGGCCTCCACCAAGAATGTGATGCTTGCCTCCTGGTCCGGAAAGGCCTC

ATAATCCAAACTCCTCAGAAGAGACAATTCTCCAGTGAATGGATGCAGTGCAAAAAGGTGTTTC

ACTTCTGGGCTTCTGATCCGATATGACACATTGGCTCCAAGGTCAACATCCTTGGCCTCTATTT

GAAGAAAGGAGGTCCCGGCTGGCAGATTCTCTTCAACGACAACTGTGTACGTTGAATTGGTAAA

AACAGGACTGTTATCATTTGCATCCATCACTCGGATATTGACCACGACTGGCTCACTTTCTTGC

ACGCCATCAAACGCTGTTATCAGAAAGGTGTAGGTTTGCTGTTCCTCCCTGTCCACAGGTTGAA

GCAGGGTGAGGTAGCGGGTGATACCAGTGGGTGTCACAGTGAAGACCGAGGTGTAGTCATTCAG

GAAGAGGTGGAGCTCTGGATCTTTTGTGTCTTCTATGTCTTTGTCCAGAGCTACAATTCTCAGA

GGAGTGGTTAAGTTTAGGCTCTCAGAAATGGTGGCTCCCACTGGGGCGGATTCCAGGATGTATC

CTTGATAGCTGGGCATTGTGAAGTATGGACTCTGATTGTTTTCGTCTAGTATTTCGATGTGCAG

ACTAGCAAAGGCAGGAAGTGGGTGGCCATTGTCCTGCTCAGCCTTAATAACCAAATCAAATTTT

TGATGGAAGTCTCTGTTTACTGGCTCCAGGAGAGTGAGTTCTGCAGTCCTGGGATGCATATGGA

AGAAGCGGGGGTAATCCTCAGGGGTGCCGACAAGGATGGAGTAGAGGATGCCAGGTCGATCAGA

TGGTGGTTGGATGTTTCGGTCCTGATCAATGGCTTGGATAGGTGGTGTCACCAAAATAGGGTTC

AGTTCTTCCGGAGTCCTCAGTTCAGGAATGGCAGCTTGGTAGGTGAGTGGACGACAGTCACGTG

TGTTTGGCACAAGAACACAAGGCAGAAACATAGGTCCCAGGTCATCTCCATCTAGAACATCTAC

TGTGAGGGTGGTGGTGGTTGTTCGCCTCTCATTCAGATTTTGTGCACGGTCATTTGCTTGGATG

ATGACATAGTAGCGAGTCTTATCCTCATAGTTGAGTCTTTTCCTCAGTACCACGTTGCCAGTCA

GCATGAGTGGAATTTCAAAGGTGTCGTTGGATGTCGGATCTTCTGGGTTGTACTGAATCACGTA

TTCTATCTGTCCATTAGGGCCATCGTCTATGTCTGTAGCTCCATTGTCTCCCGAGAACCCCGTG

AATATCGTGGTGCCAACTGGAGTGAGCTCATTCACGGTGGCATAGTAGCTTTCATGCTTGAATG

TGGGGGAGTTGTCATTCCGATCTCGCACCACGATGCGTACTTCATGATAGATAACTGTGCCAAC

CTTCTTGTTGACACACTGGACTTGCACCACAATGGAGTGTATGTTCATTGGTGGGTCTCTATCC

AGAACTCTTCCGGTACTGTTCAGGAAAAGCATCTGTTTAACGGGGTCCAGCAACACCCAGTAGT

CCACGTTGTCCTTTAAAGAGAGCTCTATGGTGGGGTCTGGTCCTCCGGCAGTCCCCTTAATCAA

CATGTTATCCACCAGAATTGTACCGTTTCGACTCTCTTCATCAATGGCCACGATAGTAGCTGGT
```

-continued

GGTCCTCCCCTAGCTAGTTTGCAATCCTCGTATTGCCAGTCATCGTCATACTGGCCCCAGCTGA

CTACCAAGAGAGAGGCAATGAGGATCCCATGGGGTAAACACTTCCAGACAGCAAACTGTAGGAA

CAT

Mouse mini-PCDH15-CD2-1-V3

(SEQ ID NO: 63)

AAGGGCTGTGTTGTAACCTTCGGAGTTTGCGCCTGGAGATTTCTTGGGCTCTTCATCCTTCCTT

CTGTCATATTCTGGCACCTGAAAGCCCCAGGGGCCTCCGGAGAGACTCTCACTGGTACTGCTGC

TGCTGCTCAGTTCTGACTCTGACTCCTCACTTTCCACGCCCCTCTCCATGGAGACTGATTCTGC

ACTGCCCTCCTCTGGGACATCCTGAGCCTCCAGGTCTGTGGACTCATCCATGGGAGCTGCTTCG

CTTTCTTCTCCTTCCTCTGCCCGTTCTTCCTCCTCTAGTGGGGGCTCTTCTTCCTCTTCCACCG

GGGGCTCCTCTCTCTTACCTTTCACCTCCTGGATTTCCTCGACCACAGGCCTTCTTCTAGCCAG

CACGATGTTTTTTCTTGCTTTCTCTCCCTCTGACTCAGTGGACTCAGACTCCTCTGACTCCGGG

GTAGAGCTCTCCTCCGCTTCCTCAGATGGGGTCTCCGACTCTGATTCTTCAGTTGTCTCGGACT

CGCTGAACTCGGACTCCGTTTCTGTGTATTCTGTGTAGTCGCTGGACTCCTCCTCTGACTCCAC

GGTGCTTTCGGTAGCTTCCTCCTGGTCTAGAGTCAGTTGAAGATAGTCTTTGTCTTCTTCATCA

AGGCGCCTCCTCCACTCCTCGCCCTCAAGGTCAATGCCTCTTTTCTCAGCGAGACCTCTGACTT

TCTTAAAAATCATCGGGAATATCCTGGCTCTCTTCCACGTTGGGTATGTGGGCTCAGCCGCTGG

TGGCTTCTCAACGGTGACTACCACCTCCTCCTCACTAGGCTCTCTAATTTCAACTTTGGGTTTT

TTAACTTTCTCTGGCTCTACCTCTTCTTCTTCATATTCCTCTTCAGCTTCACCAATGACTTCGC

CGTATTCCTCCTGTCCAGCAGGTGGCAGCAGTCGACGGCGACTTCCATACTGGGGCATCTCATA

CTTATGCATTGCGCTCTCTCCCAGTTCTTCATAGAGATGTGCTCCTGGTGGTGGTGGTGGCGGG

GGCGGGGGCGGCGCAGGCGCAGCTGGTACAGGAGCTGCAGGCTTGGCTGCAGGCATAGCAGACT

GAATTCTTGCGGTCTTCGTGCACTCAGCCTGGCGTACTTTAAACTGTCGGTAGCTTACTAAGAC

GACCAAGATGGCTGGGATGCAACAGAGGATGATGATGAAGGCCAAGGCCAGCAAGGCCCCTTCT

GTGTACCCCAAGCTTTCTCCTCGCTTCTTGATGCTCGTCACTGCCTCAGGTGTCCGAATCTCCA

GAATGCGCCCTCCTTCCCCGTAATACGGCTGGAAGTCTTTATTGATATCGAGCAGTTTGCCGTC

CAGGAACTTAAAAAGCTCATTTCTGTCGATGGCTCTGTTGGTCTGCGGGTCGATGGCATAGACA

GTCAGGTCGCACTTGCTATAGTCTTCTAGGGAGTAGGCGTCTCCATGGCGACGGGCACCTATGG

ACTCCACCACAACCTTGGCACCAGGAATTTGCTCCTGAACGTAGCGATCCAAAATCTCTGTAAG

GTCTTCTATCTTCTTTTCCACTAGTGTAGGGGGCACATTGGAGACAATGACCTGCATATCCAGT

TGATTGACCACGGAGACCAGTACGTCTGCTTTCCCGCTCAACCCCTTCCCGTAGTCGTCAGTTG

CAATCACTTGAAACTTGAAGTAGGATCTTCTCATATTGTGGAAGAGCATGGCTGTCTTGATGAG

ACCTGTGTATGTTTCCACCACAAACCCCTCTTTGCCCTCTTTAATCGGCGGTATGATGAGCCGG

TAGGCCATGGCACTGTAATTACCCGTGTCCCTGTCGGTGGCCTTCACTCTGAGCACAGATGCGA

ACATCCTTGCGTCTTCAGACACACCTCCAATGTAGAATTTCTTCTGGAACACTGGGGGGTGATC

GTTTTCATCCTGAATCTCAATGTACACCTTAGCTGTATTGCTTTTTGAAGGGACTCGGAGATTG

GCAAGGACCACTTCCAGAGAATCTGCTTGTACCCGGAGCACATAGCTGGTCCTTGTCTCGTAAT

CCAATGGTGAATTCACATAGATGACCCCAGTGACATTGTTGATTCCAAACTTGTCTTCCTCATT

TCCTGCCACAATGGAGTACACGATGCTCTGATTAATGGCAGCAGCAGAAATGACACCAACTACA

GTCCCTCTGGCCGCAAGCTCACTTACAGGAGGAGGTCTGTATTCCTCTTGGGTGAAGCGTGGGA

TCTCTCCAGGATGTAAGACAAGAATTCTCACCGTGGCACTGCTGGACATCACAGGTTCGCCGTC

ATCAAAAGCCACAACCACCAGCTTGAAAATCGTAGTAGGCTCTTCATTAAGATTGACGCGGGTT

-continued

```
ACTACTCTTCCAGAATCTTCCTCTACATCAAAAATACTGGCTGGGTATGGAAACTGCACGTCGT

CCACTCGATACCTCACCCTACTTGCAGGCATCCCAGGTGGGTCCGCATCTTCAGCATAAACGGT

GGTGATTGGTGTCCCCTTGACTGCATCTGGAGCCACCATCCCCTTGTAGATGCGTTTGCTAAAC

ACTGGAGGGTAGTCATTCATGTCCTTCACAATTACCGTGACTGTTGCTATACCAGGTGGCATAG

TCCCATAAATGTCAAAGGCCTCCACCAAGAATGTGATGCTTGCCTCCTGGTCCGGAAAGGCCTC

ATAATCCAAACTCCTCAGAAGAGACAATTCTCCAGTGAATGGATGCAGTGCAAAAAGGTGTTTC

ACTTCTGGGCTTCTGATCCGATATGACACATTGGCTCCAAGGTCAACATCCTTGGCCTCTATTT

GAAGAAAGGAGGTCCCGGCTGGCAGATTCTCTTCAACGCAACTGTGTACGTTGAATTGGTAAA

AACAGGACTCTGATTGTTTTCGTCTAGTATTTCGATGTGCAGACTAGCAAAGGCAGGAAGTGGG

TGGCCATTGTCCTGCTCAGCCTTAATAACCAAATCAAATTTTTGATGGAAGTCTCTGTTTACTG

GCTCCAGGAGAGTGAGTTCTGCAGTCCTGGGATGCATATGGAAGAAGCGGGGGTAATCCTCAGG

GGTGCCGACAAGGATGGAGTAGAGGATGCCAGGTCGATCAGATGGTGGTTGGATGTTTCGGTCC

TGATCAATGGCTTGGATAGGTGGTGTCACCAAAATAGGGTTCAGTTCTTCCGGAGTCCTCAGTT

CAGGAATGGCAGCTTGGTAGGTGAGTGGACGACAGTCACGTGTGTTTGGCACAAGAACACAAGG

CAGAAACATAGGTCCCAGGTCATCTCCATCTAGAACATCTACTGTGAGGGTGGTGGTGGTTGTT

CGCCTCTCATTCAGATTTTGTGCACGGTCATTTGCTTGGATGATGACATAGTAGCGAGTCTTAT

CCTCATAGTTGAGTCTTTTCCTCAGTACCACGTTGCCAGTCAGCATGAGTGGAATTTCAAAGGT

GTCGTTGGATGTCGGATCTTCTGGGTTGTACTGAATCACGTATTCTATCTGTCCATTAGGGCCA

TCGTCTATGTCTGTAGCTCCATTGTCTCCCGAGAACCCCGTGAATATCGTGGTGCCAACTGGAG

TGAGCTCATTCACGGTGGCATAGTAGCTTTCATGCTTGAATGTGGGGGAGTTGTCATTCCGATC

TCGCACCACGATGCGTACTTCATGATAGATAACTGTGCCAACCTTCTTGTTGACACACTGGACT

TGCACCACAATGGAGTGTATGTTCATTGGTGGGTCTCTATCCAGAACTCTTCCGGTACTGTTCA

GGAAAAGCATCTGTTTAACGGGGTCCAGCAACACCCAGTAGTCCACGTTGTCCTTTAAAGAGAG

CTCTATGGTGGGGTCTGGTCCTCCGGCAGTCCCCTTAATCAACATGTTATCCACCAGAATTGTA

CCGTTTCGACTCTCTTCATCAATGGCCACGATAGTAGCTGGTGGTCCTCCCCTAGCTAGTTTGC

AATCCTCGTATTGCCAGTCATCGTCATACTGGCCCCAGCTGACTACCAAGAGAGAGGCAATGAG

GATCCCATGGGGTAAACACTTCCAGACAGCAAACTGTAGGAACAT
```

Mouse mini-PCDH15-CD2-1-V4

(SEQ ID NO: 64)

```
AAGGGCTGTGTTGTAACCTTCGGAGTTTGCGCCTGGAGATTTCTTGGGCTCTTCATCCTTCCTT

CTGTCATATTCTGGCACCTGAAAGCCCCAGGGGCCTCCGGAGAGACTCTCACTGGTACTGCTGC

TGCTGCTCAGTTCTGACTCTGACTCCTCACTTTCCACGCCCCTCTCCATGGAGACTGATTCTGC

ACTGCCCTCCTCTGGGACATCCTGAGCCTCCAGGTCTGTGGACTCATCCATGGGAGCTGCTTCG

CTTTCTTCTCCTTCCTCTGCCCGTTCTTCCTCCTCTAGTGGGGGCTCTTCTTCCTCTTCCACCG

GGGGCTCCTCTCTCTTACCTTTCACCTCCTGGATTTCCTCGACCACAGGCCTTCTTCTAGCCAG

CACGATGTTTTTTCTTGCTTTCTCTCCCTCTGACTCAGTGGACTCAGACTCCTCTGACTCCGGG

GTAGAGCTCTCCTCCGCTTCCTCAGATGGGGTCTCCGACTCTGATTCTTCAGTTGTCTCGGACT

CGCTGAACTCGGACTCCGTTTCTGTGTATTCTGTGTAGTCGCTGGACTCCTCCTCTGACTCCAC

GGTGCTTTCGGTAGCTTCCTCCTGGTCTAGAGTCAGTTGAAGATAGTCTTTGTCTTCTTCATCA

AGGCGCCTCCTCCACTCCTCGCCCTCAAGGTCAATGCCTCTTTTTCTCAGCGAGACCTCTGACTT

TCTTAAAAATCATCGGGAATATCCTGGCTCTCTTCCACGTTGGGTATGTGGGCTCAGCCGCTGG
```

-continued

TGGCTTCTCAACGGTGACTACCACCTCCTCCTCACTAGGCTCTCTAATTTCAACTTTGGGTTTT

TTAACTTTCTCTGGCTCTACCTCTTCTTCTTCATATTCCTCTTCAGCTTCACCAATGACTTCGC

CGTATTCCTCCTGTCCAGCAGGTGGCAGCAGTCGACGGCGACTTCCATACTGGGGCATCTCATA

CTTATGCATTGCGCTCTCTCCCAGTTCTTCATAGAGATGTGCTCCTGGTGGTGGTGGTGGCGGG

GGCGGGGGCGGCGCAGGCGCAGCTGGTACAGGAGCTGCAGGCTTGGCTGCAGGCATAGCAGACT

GAATTCTTGCGGTCTTCGTGCACTCAGCCTGGCGTACTTTAAACTGTCGGTAGCTTACTAAGAC

GACCAAGATGGCTGGGATGCAACAGAGGATGATGATGAAGGCCAAGGCCAGCAAGGCCCCTTCT

GTGTACCCCAAGCTTTCTCCTCGCTTCTTGATGCTCGTCACTGCCTCAGGTGTCCGAATCTCCA

GAATGCGCCCTCCTTCCCCGTAATACGGCTGGAAGTCTTTATTGATATCGAGCAGTTTGCCGTC

CAGGAACTTAAAAAGCTCATTTCTGTCGATGGCTCTGTTGGTCTGCGGGTCGATGGCATAGACA

GTCAGGTCGCACTTGCTATAGTCTTCTAGGGAGTAGGCGTCTCCATGGCGACGGGCACCTATGG

ACTCCACCACAACCTTGGCACCAGGAATTTGCTCCTGAACGTAGCGATCCAAAATCTCTGTAAG

GTCTTCTATCTTCTTTTCCACTAGTGTAGGGGGCACATTGGAGACAATGACCTGCATATCCAGT

TGATTGACCACGGAGACCAGTACGTCTGCTTTCCCGCTCAACCCCTTCCCGTAGTCGTCAGTTG

CAATCACTTGAAACTTGAAGTAGGATCTTCTCATATTGTGGAAGAGCATGGCTGTCTTGATGAG

ACCTGTGTATGTTTCCACCACAAACCCCTCTTTGCCCTCTTTAATCGGCGGTATGATGAGCCGG

TAGGCCATGGCACTGTAATTACCCGTGTCCCTGTCGGTGGCCTTCACTCTGAGCACAGATGCGA

ACATCCTTGCGTCTTCAGACACACCTCCAATGTAGAATTTCTTCTGGAACACTGGGGGGTGATC

GTTTTCATCCTGAATCTCAATGTACACCTTAGCTGTATTGCTTTTTGAAGGGACTCGGAGATTG

GCAAGGACCACTTCCAGAGAATCTGCTTGTACCCGGAGCACATAGCTGGTCCTTGTCTCGTAAT

CCAATGGTGAATTCACATAGATGACCCCAGTGACATTGTTGATTCCAAACTTGTCTTCCTCATT

TCCTGCCACAATGGAGTACACGATGCTCTGATTAATGGCAGCAGCAGAAATGACACCAACTACA

GTCCCTCTGGCCGCAAGCTCACTTACAGGAGGAGGTCTGTATTCCTCTTGGGTGAAGCGTGGGA

TCTCTCCAGGATGTAAGACAAGAATTCTCACCGTGGCACTGCTGGACATCACAGGTTCGCCGTC

ATCAAAAGCCACAACCACCAGCTTGAAAATCGTAGTAGGCTCTTCATTAAGATTGACGCGGGTT

ACTACTCTTCCAGAATCTTCCTCTACATCAAAAATACTGGCTGGGTATGGAAACTGCACGTCGT

CCACTCGATACCTCACCCTACTTGCAGGCATCCCAGGTGGGTCCGCATCTTCAGCATAAACGGT

GGTGATTGGTGTCCCCTTGACTGCATCTGGAGCCACCATCCCCTTGTAGATGCGTTTGCTAAAC

ACTGGAGGCTGATTGTTTTCGTCTAGTATTTCGATGTGCAGACTAGCAAAGGCAGGAAGTGGGT

GGCCATTGTCCTGCTCAGCCTTAATAACCAAATCAAATTTTTGATGGAAGTCTCTGTTTACTGG

CTCCAGGAGAGTGAGTTCTGCAGTCCTGGGATGCATATGGAAGAAGCGGGGGTAATCCTCAGGG

GTGCCGACAAGGATGGAGTAGAGGATGCCAGGTCGATCAGATGGTGGTTGGATGTTTCGGTCCT

GATCAATGGCTTGGATAGGTGGTGTCACCAAAATAGGGTTCAGTTCTTCCGGAGTCCTCAGTTC

AGGAATGGCAGCTTGGTAGGTGAGTGGACGACAGTCACGTGTGTTTGGCACAAGAACACAAGGC

AGAAACATAGGTCCCA

GGTCATCTCCATCTAGAACATCTACTGTGAGGGTGGTGGTGGTTGTTCGCCTCTCATTCAGATT

TTGTGCACGGTCATTTGCTTGGATGATGACATAGTAGCGAGTCTTATCCTCATAGTTGAGTCTT

TTCCTCAGTACCACGTTGCCAGTCAGCATGAGTGGAATTTCAAAGGTGTCGTTGGATGTCGGAT

CTTCTGGGTTGTACTGAATCACGTATTCTATCTGTCCATTAGGGCCATCGTCTATGTCTGTAGC

TCCATTGTCTCCCGAGAACCCCGTGAATATCGTGGTGCCAACTGGAGTGAGCTCATTCACGGTG

GCATAGTAGCTTTCATGCTTGAATGTGGGGGAGTTGTCATTCCGATCTCGCACCACGATGCGTA

-continued

CTTCATGATAGATAACTGTGCCAACCTTCTTGTTGACACACTGGACTTGCACCACAATGGAGTG

TATGTTCATTGGTGGGTCTCTATCCAGAACTCTTCCGGTACTGTTCAGGAAAAGCATCTGTTTA

ACGGGGTCCAGCAACACCCAGTAGTCCACGTTGTCCTTTAAAGAGAGCTCTATGGTGGGGTCTG

GTCCTCCGGCAGTCCCCTTAATCAACATGTTATCCACCAGAATTGTACCGTTTCGACTCTCTTC

ATCAATGGCCACGATAGTAGCTGGTGGTCCTCCCCTAGCTAGTTTGCAATCCTCGTATTGCCAG

TCATCGTCATACTGGCCCCAGCTGACTACCAAGAGAGAGGCAATGAGGATCCCATGGGGTAAAC

ACTTCCAGACAGCAAACTGTAGGAACAT

Mouse mini-PCDH15-CD2-1-V5                                       (SEQ ID NO: 65)

AAGGGCTGTGTTGTAACCTTCGGAGTTTGCGCCTGGAGATTTCTTGGGCTCTTCATCCTTCCTT

CTGTCATATTCTGGCACCTGAAAGCCCCAGGGGCCTCCGGAGAGACTCTCACTGGTACTGCTGC

TGCTGCTCAGTTCTGACTCTGACTCCTCACTTTCCACGCCCCTCTCCATGGAGACTGATTCTGC

ACTGCCCTCCTCTGGGACATCCTGAGCCTCCAGGTCTGTGGACTCATCCATGGGAGCTGCTTCG

CTTTCTTCTCCTTCCTCTGCCCGTTCTTCCTCCTCTAGTGGGGGCTCTTCTTCCTCTTCCACCG

GGGGCTCCTCTCTCTTACCTTTCACCTCCTGGATTTCCTCGACCACAGGCCTTCTTCTAGCCAG

CACGATGTTTTTTCTTGCTTTCTCTCCCTCTGACTCAGTGGACTCAGACTCCTCTGACTCCGGG

GTAGAGCTCTCCTCCGCTTCCTCAGATGGGGTCTCCGACTCTGATTCTTCAGTTGTCTCGGACT

CGCTGAACTCGGACTCCGTTTCTGTGTATTCTGTGTAGTCGCTGGACTCCTCCTCTGACTCCAC

GGTGCTTTCGGTAGCTTCCTCCTGGTCTAGAGTCAGTTGAAGATAGTCTTTGTCTTCTTCATCA

AGGCGCCTCCTCCACTCCTCGCCCTCAAGGTCAATGCCTCTTTTCTCAGCGAGACCTCTGACTT

TCTTAAAAATCATCGGGAATATCCTGGCTCTCTTCCACGTTGGGTATGTGGGCTCAGCCGCTGG

TGGCTTCTCAACGGTGACTACCACCTCCTCCTCACTAGGCTCTCTAATTTCAACTTTGGGTTTT

TTAACTTTCTCTGGCTCTACCTCTTCTTCTTCATATTCCTCTTCAGCTTCACCAATGACTTCGC

CGTATTCCTCCTGTCCAGCAGGTGGCAGCAGTCGACGGCGACTTCCATACTGGGGCATCTCATA

CTTATGCATTGCGCTCTCTCCCAGTTCTTCATAGAGATGTGCTCCTGGTGGTGGTGGTGGCGGG

GGCGGGGGCGGCGCAGGCGCAGCTGGTACAGGAGCTGCAGGCTTGGCTGCAGGCATAGCAGACT

GAATTCTTGCGGTCTTCGTGCACTCAGCCTGGCGTACTTTAAACTGTCGGTAGCTTACTAAGAC

GACCAAGATGGCTGGGATGCAACAGAGGATGATGATGAAGGCCAAGGCCAGCAAGGCCCCTTCT

GTGTACCCCAAGCTTTCTCCTCGCTTCTTGATGCTCGTCACTGCCTCAGGTGTCCGAATCTCCA

GAATGCGCCCTCCTTCCCCGTAATACGGCTGGAAGTCTTTATTGATATCGAGCAGTTTGCCGTC

CAGGAACTTAAAAAGCTCATTTCTGTCGATGGCTCTGTTGGTCTGCGGGTCGATGGCATAGACA

GTCAGGTCGCACTTGCTATAGTCTTCTAGGGAGTAGGCGTCTCCATGGCGACGGGCACCTATGG

ACTCCACCACAACCTTGGCACCAGGAATTTGCTCCTGAACGTAGCGATCCAAAATCTCTGTAAG

GTCTTCTATCTTCTTTTTCCACTAGTGTAGGGGGCACATTGGAGACAATGACCTGCATATCCAGT

TGATTGACCACGGAGACCAGTACGTCTGCTTTCCCGCTCAACCCCTTCCCGTAGTCGTCAGTTG

CAATCACTTGAAACTTGAAGTAGGATCTTCTCATATTGTGGAAGAGCATGGCTGTCTTGATGAG

ACCTGTGTATGTTTCCACCACAAACCCCTCTTTGCCCTCTTTAATCGGCGGTATGATGAGCCGG

TAGGCCATGGCACTGTAATTACCCGTGTCCCTGTCGGTGGCCTTCACTCTGAGCACAGATGCGA

ACATCCTTGCGTCTTCAGACACACCTCCAATGTAGAATTTCTTCTGGAACACTGGGGGGTTATC

ATCAATGTCCAACACCTTGATGTACAGTGTCAGAGTTGAATGTCGAGGGTGGACTGCTCCATCT

GTTGCCACGACAACCAGTTCATAGTGGTCCCTGGCTTCCCTGTTCAGCTTCACGGCTGTGTAAA

-continued

```
TGCTCCCGTTGGATGTGATGCGGAAGAGGTTGTTGAAGTTCCCCAGGCTGTAGTGAACTTGGCC

GTTTATCCCAGCATCTGGGTCTGTTGCCCGGACTTGACCCACAAAGGCATTGGCTTCTTCCTCC

ACCACAGAGAGGTTCCTGGGCAGATAGGGATCGAACACGGGAGCGTTGTCATTGACGTCCGTCA

CCACTATGTTCACAGTGGCAGTTGAGGTTCCATCCGGTCTGCCATCTGAGGCTGTGACGATGAG

GATGTAGCGGTCTGTGCTCTCGCGGTCTAGAGCCTTCCCTAGGCTGAGAATCCCTGTGGTTTCT

GAAAGATTAAAAACTCTCTGAGGGTCTCCATTCTCGATGGCATATGTGATTGGATCTCCCTCTC

GATCAGTTGCCTGTAGATTTAATAAAATAGCACCGATCCTCATGGCCTCGCTGACTTCCAGACT

GTACATCAGCTGCGGGAAGCGGGGAGGGCTCTGGTTGTTAGGAGGAAGCACCTCGATGTACACT

GTGCAGATGGAGTGCCTTCTTTCTGCAGGCGGGGCGTTGTCCGAAGCCTGCACTGTGAGCGCAT

ACGTCTGTCCCACGATCAGCTCCACGCCTGGTGCAATGCTCACCAGCCCTGTGGTCTTGTTGAT

CACGAAGTCTCCCTTGCCCCCCACCAGTATTTCATAGGAGATCTCCCCATTAGAGCCTTCATCA

GCATCTACCGCTGTCAGCTGAATGACGCTGTCCCCAGGACTCATGTCTGTGTAAACATAGACAT

CATAGGAGATTTCAGGGAAGGTGGGCGTCTGATTGTTTTCGTCTAGTATTTCGATGTGCAGACT

AGCAAAGGCAGGAAGTGGGTGGCCATTGTCCTGCTCAGCCTTAATAACCAAATCAAATTTTTGA

TGGAAGTCTCTGTTTACTGGCTCCAGGAGAGTGAGTTCTGCAGTCCTGGGATGCATATGGAAGA

AGCGGGGGTAATCCTCAGGGGTGCCGACAAGGATGGAGTAGAGGATGCCAGGTCGATCAGATGG

TGGTTGGATGTTTCGGTCCTGATCAATGGCTTGGATAGGTGGTGTCACCAAAATAGGGTTCAGT

TCTTCCGGAGTCCTCAGTTCAGGAATGGCAGCTTGGTAGGTGAGTGGACGACAGTCACGTGTGT

TTGGCACAAGAACACAAGGCAGAAACATAGGTCCCAGGTCATCTCCATCTAGAACATCTACTGT

GAGGGTGGTGGTGGTTGTTCGCCTCTCATTCAGATTTTGTGCACGGTCATTTGCTTGGATGATG

ACATAGTAGCGAGTCTTATCCTCATAGTTGAGTCTTTTCCTCAGTACCACGTTGCCAGTCAGCA

TGAGTGGAATTTCAAAGGTGTCGTTGGATGTCGGATCTTCTGGGTTGTACTGAATCACGTATTC

TATCTGTCCATTAGGGCCATCGTCTATGTCTGTAGCTCCATTGTCTCCCGAGAACCCCGTGAAT

ATCGTGGTGCCAACTGGAGTGAGCTCATTCACGGTGGCATAGTAGCTTTCATGCTTGAATGTGG

GGGAGTTGTCATTCCGATCTCGCACCACGATGCGTACTTCATGATAGATAACTGTGCCAACCTT

CTTGTTGACACACTGGACTTGCACCACAATGGAGTGTATGTTCATTGGTGGGTCTCTATCCAGA

ACTCTTCCGGTACTGTTCAGGAAAAGCATCTGTTTAACGGGGTCCAGCAACACCCAGTAGTCCA

CGTTGTCCTTTAAAGAGAGCTCTATGGTGGGGTCTGGTCCTCCGGCAGTCCCCTTAATCAACAT

GTTATCCACCAGAATTGTACCGTTTCGACTCTCTTCATCAATGGCCACGATAGTAGCTGGTGGT

CCTCCCCTAGCTAGTTTGCAATCCTCGTATTGCCAGTCATCGTCATACTGGCCCCAGCTGACTA

CCAAGAGAGAGGCAATGAGGATCCCATGGGGTAAACACTTCCAGACAGCAAACTGTAGGAACAT
```

Mouse mini-PCDH15-CD2-1-V6:

(SEQ ID NO: 66)

```
AAGGGCTGTGTTGTAACCTTCGGAGTTTGCGCCTGGAGATTTCTTGGGCTCTTCATCCTTCCTT

CTGTCATATTCTGGCACCTGAAAGCCCCAGGGGCCTCCGGAGAGACTCTCACTGGTACTGCTGC

TGCTGCTCAGTTCTGACTCTGACTCCTCACTTTCCACGCCCCTCTCCATGGAGACTGATTCTGC

ACTGCCCTCCTCTGGGACATCCTGAGCCTCCAGGTCTGTGGACTCATCCATGGGAGCTGCTTCG

CTTTCTTCTCCTTCCTCTGCCCGTTCTTCCTCCTCTAGTGGGGGGCTCTTCTTCCTCTTCCACCG

GGGGCTCCTCTCTCTTACCTTTCACCTCCTGGATTTCCTCGACCACAGGCCTTCTTCTAGCCAG

CACGATGTTTTTTCTTGCTTTCTCTCCCTCTGACTCAGTGGACTCAGACTCCTCTGACTCCGGG

GTAGAGCTCTCCTCCGCTTCCTCAGATGGGGTCTCCGACTCTGATTCTTCAGTTGTCTCGGACT

CGCTGAACTCGGACTCCGTTTCTGTGTATTCTGTGTAGTCGCTGGACTCCTCCTCTGACTCCAC
```

-continued

```
GGTGCTTTCGGTAGCTTCCTCCTGGTCTAGAGTCAGTTGAAGATAGTCTTTGTCTTCTTCATCA

AGGCGCCTCCTCCACTCCTCGCCCTCAAGGTCAATGCCTCTTTTCTCAGCGAGACCTCTGACTT

TCTTAAAAATCATCGGGAATATCCTGGCTCTCTTCCACGTTGGGTATGTGGGCTCAGCCGCTGG

TGGCTTCTCAACGGTGACTACCACCTCCTCCTCACTAGGCTCTCTAATTTCAACTTTGGGTTTT

TTAACTTTCTCTGGCTCTACCTCTTCTTCTTCATATTCCTCTTCAGCT

TCACCAATGACTTCGCCGTATTCCTCCTGTCCAGCAGGTGGCAGCAGTCGACGGCGACTTCCAT

ACTGGGGCATCTCATACTTATGCATTGCGCTCTCTCCCAGTTCTTCATAGAGATGTGCTCCTGG

TGGTGGTGGTGGCGGGGGCGGGGGCGGCGCAGGCGCAGCTGGTACAGGAGCTGCAGGCTTGGCT

GCAGGCATAGCAGACTGAATTCTTGCGGTCTTCGTGCACTCAGCCTGGCGTACTTTAAACTGTC

GGTAGCTTACTAAGACGACCAAGATGGCTGGGATGCAACAGAGGATGATGATGAAGGCCAAGGC

CAGCAAGGCCCCTTCTGTGTACCCCAAGCTTTCTCCTCGCTTCTTGATGCTCGTCACTGCCTCA

GGTGTCCGAATCTCCAGAATGCGCCCTCCTTCCCCGTAATACGGCTGGAAGTCTTTATTGATAT

CGAGCAGTTTGCCGTCCAGGAACTTAAAAAGCTCATTTCTGTCGATGGCTCTGTTGGTCTGCGG

GTCGATGGCATAGACAGTCAGGTCGCACTTGCTATAGTCTTCTAGGGAGTAGGCGTCTCCATGG

CGACGGGCACCTATGGACTCCACCACAACCTTGGCACCAGGAATTTGCTCCTGAACGTAGCGAT

CCAAAATCTCTGTAAGGTCTTCTATCTTCTTTTCCACTAGTGTAGGGGGCACATTGGAGACAAT

GACCTGCATATCCAGTTGATTGACCACGGAGACCAGTACGTCTGCTTTCCCGCTCAACCCCTTC

CCGTAGTCGTCAGTTGCAATCACTTGAAACTTGAAGTAGGATCTTCTCATATTGTGGAAGAGCA

TGGCTGTCTTGATGAGACCTGTGTATGTTTCCACCACAAACCCCTCTT

TGCCCTCTTTAATCGGCGGTATGATGAGCCGGTAGGCCATGGCACTGTAATTACCCGTGTCCCT

GTCGGTGGCCTTCACTCTGAGCACAGATGCGAACATCCTTGCGTCTTCAGACACACCTCCAATG

TAGAATTTCTTCTGGAACACTGGGGGGGTAGTCATTCATGTCCTTCACAATTACCGTGACTGTTG

CTATACCAGGTGGCATAGTCCCATAAATGTCAAAGGCCTCCACCAAGAATGTGATGCTTGCCTC

CTGGTCCGGAAAGGCCTCATAATCCAAACTCCTCAGAAGAGACAATTCTCCAGTGAATGGATGC

AGTGCAAAAAGGTGTTTCACTTCTGGGCTTCTGATCCGATATGACACATTGGCTCCAAGGTCAA

CATCCTTGGCCTCTATTTGAAGAAAGGAGGTCCCGGCTGGCAGATTCTCTTCAACGACAACTGT

GTACGTTGAATTGGTAAAAACAGGACTGTTATCATCAATGTCCAACACCTTGATGTACAGTGTC

AGAGTTGAATGTCGAGGGTGGACTGCTCCATCTGTTGCCACGACAACCAGTTCATAGTGGTCCC

TGGCTTCCCTGTTCAGCTTCACGGCTGTGTAAATGCTCCCGTTGGATGTGATGCGGAAGAGGTT

GTTGAAGTTCCCCAGGCTGTAGTGAACTTGGCCGTTTATCCCAGCATCTGGGTCTGTTGCCCGG

ACTTGACCCACAAAGGCATTGGCTTCTTCCTCCACCACAGAGAGGTTCCTGGGCAGATAGGGAT

CGAACACGGGAGCGTTATCATTTGCATCCATCACTCGGATATTGACCACGACTGGCTCACTTTC

TTGCACGCCATCAAACGCTGTTATCAGAAAGGTGTAGGTTTGCTGTTCCTCCCTGTCCACAGGT

TGAAGCAGGGTGAGGTAGCGGGTGATACCAGTGGGTGTCACAGTGAAGACCGAGGTGTAGTCAT

TCAGGAAGAGGTGGAGCTCTGGATCTTTTGTGTCTTCTATGTCTTTGTCCAGAGCTACAATTCT

CAGAGGAGTGGTTAAGTTTAGGCTCTCAGAAATGGTGGCTCCCACTGGGGCGGATTCCAGGATG

TATCCTTGATAGCTGGGCATTGTGAAGTATGGACTCTGATTGTTTTCGTCTAGTATTTCGATGT

GCAGACTAGCAAAGGCAGGAAGTGGGTGGCCATTGTCCTGCTCAGCCTTAATAACCAAATCAAA

TTTTTGATGGAAGTCTCTGTTTACTGGCTCCAGGAGAGTGAGTTCTGCAGTCCTGGGATGCATA

TGGAAGAAGCGGGGGTAATCCTCAGGGGTGCCGACAAGGATGGAGTAGAGGATGCCAGGTCGAT
```

-continued

CAGATGGTGGTTGGATGTTTCGGTCCTGATCAATGGCTTGGATAGGTGGTGTCACCAAAATAGG

GTTCAGTTCTTCCGGAGTCCTCAGTTCAGGAATGGCAGCTTGGTAGGTGAGTGGACGACAGTCA

CGTGTGTTTGGCACAAGAACACAAGGCAGAAACATAGGTCCCAGGTCATCTCCATCTAGAACAT

CTACTGTGAGGGTGGTGGTGGTTGTTCGCCTCTCATTCAGATTTTGTGCACGGTCATTTGCTTG

GATGATGACATAGTAGCGAGTCTTATCCTCATAGTTGAGTCTTTTCCTCAGTACCACGTTGCCA

GTCAGCATGAGTGGAATTTCAAAGGTGTCGTTGGATGTCGGATCTTCTGGGTTGTACTGAATCA

CGTATTCTATCTGTCCATTAGGGCCATCGTCTATGTCTGTAGCTCCATTGTCTCCCGAGAACCC

CGTGAATATCGTGGTGCCAACTGGAGTGAGCTCATTCACGGTGGCATAGTAGCTTTCATGCTTG

AATGTGGGGGAGTTGTCATTCCGATCTCGCACCACGATGCGTACTTCATGATAGATAACTGTGC

CAACCTTCTTGTTGACACACTGGACTTGCACCACAATGGAGTGTATGTTCATTGGTGGGTCTCT

ATCCAGAACTCTTCCGGTACTGTTCAGGAAAAGCATCTGTTTAACGGGGTCCAGCAACACCCAG

TAGTCCACGTTGTCCTTTAAAGAGAGCTCTATGGTGGGGTCTGGTCCTCCGGCAGTCCCCTTAA

TCAACATGTTATCCACCAGAATTGTACCGTTTCGACTCTCTTCATCAATGGCCACGATAGTAGC

TGGTGGTCCTCCCCTAGCTAGTTTGCAATCCTCGTATTGCCAGTCATCGTCATACTGGCCCCAG

CTGACTACCAAGAGAGAGGCAATGAGGATCCCATGGGGTAAACACTTCCAGACAGCAAACTGTA

GGAACAT

Mouse mini-PCDH15-CD2-1-V7:

(SEQ ID NO: 67)

AAGGGCTGTGTTGTAACCTTCGGAGTTTGCGCCTGGAGATTTCTTGGGCTCTTCATCCTTCCTT

CTGTCATATTCTGGCACCTGAAAGCCCCAGGGGCCTCCGGAGAGACTCTCACTGGTACTGCTGC

TGCTGCTCAGTTCTGACTCTGACTCCTCACTTTCCACGCCCCTCTCCATGGAGACTGATTCTGC

ACTGCCCTCCTCTGGGACATCCTGAGCCTCCAGGTCTGTGGACTCATCCATGGGAGCTGCTTCG

CTTTCTTCTCCTTCCTCTGCCCGTTCTTCCTCCTCTAGTGGGGGCTCTTCTTCCTCTTCCACCG

GGGGCTCCTCTCTCTTACCTTTCACCTCCTGGATTTCCTCGACCACAGGCCTTCTTCTAGCCAG

CACGATGTTTTTTCTTGCTTTCTCTCCCTCTGACTCAGTGGACTCAGACTCCTCTGACTCCGGG

GTAGAGCTCTCCTCCGCTTCCTCAGATGGGGTCTCCGACTCTGATTCTTCAGTTGTCTCGGACT

CGCTGAACTCGGACTCCGTTTCTGTGTATTCTGTGTAGTCGCTGGACTCCTCCTCTGACTCCAC

GGTGCTTTCGGTAGCTTCCTCCTGGTCTAGAGTCAGTTGAAGATAGTCTTTGTCTTCTTCATCA

AGGCGCCTCCTCCACTCCTCGCCCTCAAGGTCAATGCCTCTTTTCTCAGCGAGACCTCTGACTT

TCTTAAAAATCATCGGGAATATCCTGGCTCTCTTCCACGTTGGGTATGTGGGCTCAGCCGCTGG

TGGCTTCTCAACGGTGACTACCACCTCCTCCTCACTAGGCTCTCTAATTTCAACTTTGGGTTTT

TTAACTTTCTCTGGCTCTACCTCTTCTTCTTCATATTCCTCTTCAGCTTCACCAATGACTTCGC

CGTATTCCTCCTGTCCAGCAGGTGGCAGCAGTCGACGGCGACTTCCATACTGGGGCATCTCATA

CTTATGCATTGCGCTCTCTCCCAGTTCTTCATAGAGATGTGCTCCTGGTGGTGGTGGTGGCGGG

GGCGGGGGCGGCGCAGGCGCAGCTGGTACAGGAGCTGCAGGCTTGGCTGCAGGCATAGCAGACT

GAATTCTTGCGGTCTTCGTGCACTCAGCCTGGCGTACTTTAAACTGTCGGTAGCTTACTAAGAC

GACCAAGATGGCTGGGATGCAACAGAGGATGATGATGAAGGCCAAGGCCAGCAAGGCCCCTTCT

GTGTACCCCAAGCTTTCTCCTCGCTTCTTGATGCTCGTCACTGCCTCAGGTGTCCGAATCTCCA

GAATGCGCCCTCCTTCCCCGTAATACGGCTGGAAGTCTTTATTGATATCGAGCAGTTTGCCGTC

CAGGAACTTAAAAAGCTCATTTCTGTCGATGGCTCTGTTGGTCTGCGGGTCGATGGCATAGACA

GTCAGGTCGCACTTGCTATAGTCTTCTAGGGAGTAGGCGCTCCATGGCGACGGGCACCTATGG

ACTCCACCACAACCTTGGCACCAGGAATTTGCTCCTGAACGTAGCGATCCAAAATCTCTGTAAG

-continued

```
GTCTTCTATCTTCTTTTCCACTAGTGTAGGGGGCACATTGGAGACAATGACCTGCATATCCAGT

TGATTGACCACGGAGACCAGTACGTCTGCTTTCCCGCTCAACCCCTTCCCGTAGTCGTCAGTTG

CAATCACTTGAAACTTGAAGTAGGATCTTCTCATATTGTGGAAGAGCATGGCTGTCTTGATGAG

ACCTGTGTATGTTTCCACCACAAACCCCTCTTTGCCCTCTTTAATCGGCGGTATGATGAGCCGG

TAGGCCATGGCACTGTAATTACCCGTGTCCCTGTCGGTGGCCTTCACTCTGAGCACAGATGCGA

ACATCCTTGCGTCTTCAGACACACCTCCAATGTAGAATTTCTTCTGGAACACTGGGGGGTAGTC

ATTCATGTCCTTCACAATTACCGTGACTGTTGCTATACCAGGTGGCATAGTCCCATAAATGTCA

AAGGCCTCCACCAAGAATGTGATGCTTGCCTCCTGGTCCGGAAAGGCCTCATAATCCAAACTCC

TCAGAAGAGACAATTCTCCAGTGAATGGATGCAGTGCAAAAAGGTGTTTCACTTCTGGGCTTCT

GATCCGATATGACACATTGGCTCCAAGGTCAACATCCTTGGCCTCTATTTGAAGAAAGGAGGTC

CCGGCTGGCAGATTCTCTTCAACGACAACTGTGTACGTTGAATTGGTAAAAACAGGACTGTTAT

CATCAATGTCCAACACCTTGATGTACAGTGTCAGAGTTGAATGTCGAGGGTGGACTGCTCCATC

TGTTGCCACGACAACCAGTTCATAGTGGTCCCTGGCTTCCCTGTTCAGCTTCACGGCTGTGTAA

ATGCTCCCGTTGGATGTGATGCGGAAGAGGTTGTTGAAGTTCCCCAGGCTGTAGTGAACTTGGC

CGTTTATCCCAGCATCTGGGTCTGTTGCCCGGACTTGACCCACAAAGGCATTGGCTTCTTCCTC

CACCACAGAGAGGTTCCTGGGCAGATAGGGATCGAACACGGGAGCCTGATTGTTTTCGTCTAGT

ATTTCGATGTGCAGACTAGCAAAGGCAGGAAGTGGGTGGCCATTGTCCTGCTCAGCCTTAATAA

CCAAATCAAATTTTTGATGGAAGTCTCTGTTTACTGGCTCCAGGAGAGTGAGTTCTGCAGTCCT

GGGATGCATATGGAAGAAGCGGGGGTAATCCTCAGGGGTGCCGACAAGGATGGAGTAGAGGATG

CCAGGTCGATCAGATGGTGGTTGGATGTTTCGGTCCTGATCAATGGCTTGGATAGGTGGTGTCA

CCAAAATAGGGTTCAGTTCTTCCGGAGTCCTCAGTTCAGGAATGGCAGCTTGGTAGGTGAGTGG

ACGACAGTCACGTGTGTTTGGCACAAGAACACAAGGCAGAAACATAGGTCCCAGGTCATCTCCA

TCTAGAACATCTACTG

TGAGGGTGGTGGTGGTTGTTCGCCTCTCATTCAGATTTTGTGCACGGTCATTTGCTTGGATGAT

GACATAGTAGCGAGTCTTATCCTCATAGTTGAGTCTTTTCCTCAGTACCACGTTGCCAGTCAGC

ATGAGTGGAATTTCAAAGGTGTCGTTGGATGTCGGATCTTCTGGGTTGTACTGAATCACGTATT

CTATCTGTCCATTAGGGCCATCGTCTATGTCTGTAGCTCCATTGTCTCCCGAGAACCCCGTGAA

TATCGTGGTGCCAACTGGAGTGAGCTCATTCACGGTGGCATAGTAGCTTTCATGCTTGAATGTG

GGGGAGTTGTCATTCCGATCTCGCACCACGATGCGTACTTCATGATAGATAACTGTGCCAACCT

TCTTGTTGACACACTGGACTTGCACCACAATGGAGTGTATGTTCATTGGTGGGTCTCTATCCAG

AACTCTTCCGGTACTGTTCAGGAAAAGCATCTGTTTAACGGGGTCCAGCAACACCCAGTAGTCC

ACGTTGTCCTTTAAAGAGAGCTCTATGGTGGGGTCTGGTCCTCCGGCAGTCCCCTTAATCAACA

TGTTATCCACCAGAATTGTACCGTTTCGACTCTCTTCATCAATGGCCACGATAGTAGCTGGTGG

TCCTCCCCTAGCTAGTTTGCAATCCTCGTATTGCCAGTCATCGTCATACTGGCCCCAGCTGACT

ACCAAGAGAGAGGCAATGAGGATCCCATGGGGTAAACACTTCCAGACAGCAAACTGTAGGAACA

T
```

Mouse mini-PCDH15-CD2-1-V8:

(SEQ ID NO: 68)

```
AAGGGCTGTGTTGTAACCTTCGGAGTTTGCGCCTGGAGATTTCTTGGGCTCTTCATCCTTCCTT

CTGTCATATTCTGGCACCTGAAAGCCCCAGGGGCCTCCGGAGAGACTCTCACTGGTACTGCTGC

TGCTGCTCAGTTCTGACTCTGACTCCTCACTTTCCACGCCCCTCTCCATGGAGACTGATTCTGC
```

-continued

```
ACTGCCCTCCTCTGGGACATCCTGAGCCTCCAGGTCTGTGGACTCATCCATGGGAGCTGCTTCG

CTTTCTTCTCCTTCCTCTGCCCGTTCTTCCTCCTCTAGTGGGGGCTCTTCTTCCTCTTCCACCG

GGGGCTCCTCTCTCTTACCTTTCACCTCCTGGATTTCCTCGACCACAGGCCTTCTTCTAGCCAG

CACGATGTTTTTTCTTGCTTTCTCTCCCTCTGACTCAGTGGACTCAGACTCCTCTGACTCCGGG

GTAGAGCTCTCCTCCGCTTCCTCAGATGGGGTCTCCGACTCTGATTCTTCAGTTGTCTCGGACT

CGCTGAACTCGGACTCCGTTTCTGTGTATTCTGTGTAGTCGCTGGACTCCTCCTCTGACTCCAC

GGTGCTTTCGGTAGCTTCCTCCTGGTCTAGAGTCAGTTGAAGATAGTCTTTGTCTTCTTCATCA

AGGCGCCTCCTCCACTCCTCGCCCTCAAGGTCAATGCCTCTTTTCTCAGCGAGACCTCTGACTT

TCTTAAAAATCATCGGGAATATCCTGGCTCTCTTCCACGTTGGGTATGTGGGCTCAGCCGCTGG

TGGCTTCTCAACGGTGACTACCACCTCCTCCTCACTAGGCTCTCTAATTTCAACTTTGGGTTTT

TTAACTTTCTCTGGCTCTACCTCTTCTTCTTCATATTCCTCTTCAGCTTCACCAATGACTTCGC

CGTATTCCTCCTGTCCAGCAGGTGGCAGCAGTCGACGGCGACTTCCATACTGGGGCATCTCATA

CTTATGCATTGCGCTCTCTCCCAGTTCTTCATAGAGATGTGCTCCTGGTGGTGGTGGTGGCGGG

GGCGGGGGCGGCGCAGGCGCAGCTGGTACAGGAGCTGCAGGCTTGGCTGCAGGCATAGCAGACT

GAATTCTTGCGGTCTTCGTGCACTCAGCCTGGCGTACTTTAAACTGTCGGTAGCTTACTAAGAC

GACCAAGATGGCTGGGATGCAACAGAGGATGATGATGAAGGCCAAGGCCAGCAAGGCCCCTTCT

GTGTACCCCAAGCTTTCTCCTCGCTTCTTGATGCTCGTCACTGCCTCAGGTGTCCGAATCTCCA

GAATGCGCCCTCCTTCCCCGTAATACGGCTGGAAGTCTTTATTGATATCGAGCAGTTTGCCGTC

CAGGAACTTAAAAAGCTCATTTCTGTCGATGGCTCTGTTGGTCTGCGGGTCGATGGCATAGACA

GTCAGGTCGCACTTGCTATAGTCTTCTAGGGAGTAGGCGTCTCCATGGCGACGGGCACCTATGG

ACTCCACCACAACCTTGGCACCAGGAATTTGCTCCTGAACGTAGCGATCCAAAATCTCTGTAAG

GTCTTCTATCTTCTTTTCCACTAGTGTAGGGGGCACATTGGAGACAATGACCTGCATATCCAGT

TGATTGACCACGGAGACCAGTACGTCTGCTTTCCCGCTCAACCCCTTCCCGTAGTCGTCAGTTG

CAATCACTTGAAACTTGAAGTAGGATCTTCTCATATTGTGGAAGAGCATGGCTGTCTTGATGAG

ACCTGTGTATGTTTCCACCACAAACCCCTCTTTGCCCTCTTTAATCGGCGGTATGATGAGCCGG

TAGGCCATGGCACTGTAATTACCCGTGTCCCTGTCGGTGGCCTTCACTCTGAGCACAGATGCGA

ACATCCTTGCGTCTTCAGACACACCTCCAATGTAGAATTTCTTCTGGAACACTGGGGGGTTATC

ATCAATGTCCAACACCTTGATGTACAGTGTCAGAGTTGAATGTCGAGGGTGGACTGCTCCATCT

GTTGCCACGACAACCAGTTCATAGTGGTCCCTGGCTTCCCTGTTCAGCTTCACGGCTGTGTAAA

TGCTCCCGTTGGATGTGATGCGGAAGAGGTTGTTGAAGTTCCCCAGGCTGTAGTGAACTTGGCC

GTTTATCCCAGCATCTGGGTCTGTTGCCCGGACTTGACCCACAAAGGCATTGGCTTCTTCCTCC

ACCACAGAGAGGTTCCTGGGCAGATAGGGATCGAACACGGGAGCGTTATCATTTGCATCCATCA

CTCGGATATTGACCACGACTGGCTCACTTTCTTGCACGCCATCAAACGCTGTTATCAGAAAGGT

GTAGGTTTGCTGTTCCTCCCTGTCCACAGGTTGAAGCAGGGTGAGGTAGCGGGTGATACCAGTG

GGTGTCACAGTGAAGACCGAGGTGTAGTCATTCAGGAAGAGGTGGAGCTCTGGATCTTTTGTGT

CTTCTATGTCTTTGTCCAGAGCTACAATTCTCAGAGGAGTGGTTAAGTTTAGGCTCTCAGAAAT

GGTGGCTCCCACTGGGGCGGATTCCAGGATGTATCCTTGATAGCTGGGCATTGTGAAGTATGGA

CTCTGATTGTTTTCGTCTAGTATTTCGATGTGCAGACTAGCAAAGGCAGGAAGTGGGTGGCCAT

TGTCCTGCTCAGCCTTAATAACCAAATCAAATTTTTGATGGAAGTCTCTGTTTACTGGCTCCAG

GAGAGTGAGTTCTGCAGTCCTGGGATGCATATGGAAGAAGCGGGGGTAATCCTCAGGGGTGCCG

ACAAGGATGGAGTAGAGGATGCCAGGTCGATCAGATGGTGGTTGGATGTTTCGGTCCTGATCAA
```

-continued

TGGCTTGGATAGGTGGTGTCACCAAAATAGGGTTCAGTTCTTCCGGAGTCCTCAGTTCAGGAAT

GGCAGCTTGGTAGGTGAGTGGACGACAGTCACGTGTGTTTGGCACAAGAACACAAGGCAGAAAC

ATAGGTCCCAGGTCAT

CTCCATCTAGAACATCTACTGTGAGGGTGGTGGTGGTTGTTCGCCTCTCATTCAGATTTTGTGC

ACGGTCATTTGCTTGGATGATGACATAGTAGCGAGTCTTATCCTCATAGTTGAGTCTTTTCCTC

AGTACCACGTTGCCAGTCAGCATGAGTGGAATTTCAAAGGTGTCGTTGGATGTCGGATCTTCTG

GGTTGTACTGAATCACGTATTCTATCTGTCCATTAGGGCCATCGTCTATGTCTGTAGCTCCATT

GTCTCCCGAGAACCCCGTGAATATCGTGGTGCCAACTGGAGTGAGCTCATTCACGGTGGCATAG

TAGCTTTCATGCTTGAATGTGGGGGAGTTGTCATTCCGATCTCGCACCACGATGCGTACTTCAT

GATAGATAACTGTGCCAACCTTCTTGTTGACACACTGGACTTGCACCACAATGGAGTGTATGTT

CATTGGTGGGTCTCTATCCAGAACTCTTCCGGTACTGTTCAGGAAAAGCATCTGTTTAACGGGG

TCCAGCAACACCCAGTAGTCCACGTTGTCCTTTAAAGAGAGCTCTATGGTGGGGTCTGGTCCTC

CGGCAGTCCCCTTAATCAACATGTTATCCACCAGAATTGTACCGTTTCGACTCTCTTCATCAAT

GGCCACGATAGTAGCTGGTGGTCCTCCCCTAGCTAGTTTGCAATCCTCGTATTGCCAGTCATCG

TCATACTGGCCCCAGCTGACTACCAAGAGAGAGGCAATGAGGATCCCATGGGTAAACACTTCC

AGACAGCAAACTGTAGGAACAT

Mouse mini-PCDH15-CD2-1-V9:

(SEQ ID NO: 152)

ATGTTCCTACAGTTTGCTGTCTGGAAGTGTTTACCCCATGGGATCCTCATTGCCTCTCTCTTGG

TAGTCAGCTGGGGCCAGTATGACGATGACTGGCAATACGAGGATTGCAAACTAGCTAGGGGAGG

ACCACCAGCTACTATCGTGGCCATTGATGAAGAGAGTCGAAACGGTACAATTCTGGTGGATAAC

ATGTTGATTAAGGGGACTGCCGGAGGACCAGACCCCACCATAGAGCTCTCTTTAAAGGACAACG

TGGACTACTGGGTGTTGCTGGACCCCGTTAAACAGATGCTTTTCCTGAACAGTACCGGAAGAGT

TCTGGATAGAGACCCACCAATGAACATACACTCCATTGTGGTGCAAGTCCAGTGTGTCAACAAG

AAGGTTGGCACAGTTATCTATCATGAAGTACGCATCGTGGTGCGAGATCGGAATGACAACTCCC

CCACATTCAAGCATGAAAGCTACTATGCCACCGTGAATGAGCTCACTCCAGTTGGCACCACGAT

ATTCACGGGGTTCTCGGGAGACAATGGAGCTACAGACATAGACGATGGCCCTAATGGACAGATA

GAATACGTGATTCAGTACAACCCAGAAGATCCGACATCCAACGACACCTTTGAAATTCCACTCA

TGCTGACTGGCAACGTGGTACTGAGGAAAAGACTCAACTATGAGGATAAGACTCGCTACTATGT

CATCATCCAAGCAAATGACCGTGCACAAAATCTGAATGAGAGGCGAACAACCACCACCACCCTC

ACAGTAGATGTTCTAGATGGAGATGACCTGGGACCTATGTTTCTGCCTTGTGTTCTTGTGCCAA

ACACACGTGACTGTCGTCCACTCACCTACCAAGCTGCCATTCCTGAACTGAGGACTCCGGAAGA

ACTGAACCCTATTTTGGTGACACCACCTATCCAAGCCATTGATCAGGACCGAAACATCCAACCA

CCATCTGATCGACCTGGCATCCTCTACTCCATCCTTGTCGGCACCCCTGAGGATTACCCCCCGCT

TCTTCCATATGCATCCCAGGACTGCAGAACTCACTCTCCTGGAGCCAGTAAACAGAGACTTCCA

TCAAAAATTTGATTTGGTTATTAAGGCTGAGCAGGACAATGGCCACCCACTTCCTGCCTTTGCT

AGTCTGCACATCGAAATACTAGACGAAAACAATCAGCCCCCAGTGTTCCAGAAGAAATTCTACA

TTGGAGGTGTGTCTGAAGACGCAAGGATGTTCGCATCTGTGCTCAGAGTGAAGGCCACCGACAG

GGACACGGGTAATTACAGTGCCATGGCCTACCGGCTCATCATACCGCCGATTAAAGAGGGCAAA

GAGGGGTTTGTGGTGGAAACATACACAGGTCTCATCAAGACAGCCATGCTCTTCCACAATATGA

GAAGATCCTACTTCAAGTTTCAAGTGATTGCAACTGACGACTACGGGAAGGGGTTGAGCGGGAA

-continued

AGCAGACGTACTGGTCTCCGTGGTCAATCAACTGGATATGCAGGTCATTGTCTCCAATGTGCCC

CCTACACTAGTGGAAAAGAAGATAGAAGACCTTACAGAGATTTTGGATCGCTACGTTCAGGAGC

AAATTCCTGGTGCCAAGGTTGTGGTGGAGTCCATAGGTGCCCGTCGCCATGGAGACGCCTACTC

CCTAGAAGACTATAGCAAGTGCGACCTGACTGTCTATGCCATCGACCCGCAGACCAACAGAGCC

ATCGACAGAAATGAGCTTTTTAAGTTCCTGGACGGCAAACTGCTCGATATCAATAAAGACTTCC

AGCCGTATTACGGGGAAGGAGGGCGCATTCTGGAGATTCGGACACCTGAGGCAGTGACGAGCAT

CAAGAAGCGAGGAGAAAGCTTGGGGTACACAGAAGGGGCCTTGCTGGCCTTGGCCTTCATCATC

ATCCTCTGTTGCATCCCAGCCATCTTGGTCGTCTTAGTAAGCTACCGACAGTTTAAAGTACGCC

AGGCTGAGTGCACGAAGACCGCAAGAATTCAGTCTGCTATGCCTGCAGCCAAGCCTGCAGCTCC

TGTACCAGCTGCGCCTGCGCCGCCCCCGCCCCCGCCACCACCACCACCAGGAGCACATCTCTAT

GAAGAACTGGGAGAGAGCGCAATGCATAAGTATGAGATGCCCCAGTATGGAAGTCGCCGTCGAC

TGCTGCCACCTGCTGGACAGGAGGAATACGGCGAAGTCATTGGTGAAGCTGAAGAGGAATATGA

AGAAGAAGAGGTAGAGCCAGAGAAAGTTAAAAAACCCAAAGTTGAAATTAGAGAGCCTAGTGAG

GAGGAGGTGGTAGTCACCGTTGAGAAGCCACCAGCGGCTGAGCCCACATACCCAACGTGGAAGA

GAGCCAGGATATTCCCGATGATTTTTAAGAAAGTCAGAGGTCTCGCTGAGAAAAGAGGCATTGA

CCTTGAGGGCGAGGAGTGGAGGAGGCGCCTTGATGAAGAAGACAAAGACTATCTTCAACTGACT

CTAGACCAGGAGGAAGCTACCGAAAGCACCGTGGAGTCAGAGGAGGAGTCCAGCGACTACACAG

AATACACAGAAACGGAGTCCGAGTTCAGCGAGTCCGAGACAACTGAAGAATCAGAGTCGGAGAC

CCCATCTGAGGAAGCGGAGGAGAGCTCTACCCCGGAGTCAGAGGAGTCTGAGTCCACTGAGTCA

GAGGGAGAGAAAGCAAGAAAAAACATCGTGCTGGCTAGAAGAAGGCCTGTGGTCGAGGAAATCC

AGGAGGTGAAAGGTAAGAGAGAGGAGCCCCCGGTGGAAGAGGAAGAAGAGCCCCCACTAGAGGA

GGAAGAACGGGCAGAGGAAGGAGAAGAAAGCGAAGCAGCTCCCATGGATGAGTCCACAGACCTG

GAGGCTCAGGATGTCCCAGAGGAGGGCAGTGCAGAATCAGTCTCCATGGAGAGGGGCGTGGAAA

GTGAGGAGTCAGAGTCAGAACTGAGCAGCAGCAGCAGTACCAGTGAGAGTCTCTCCGGAGGCCC

CTGGGGCTTTCAGGTGCCAGAATATGACAGAAGGAAGGATGAAGAGCCCAAGAAATCTCCAGGC

GCAAACTCCGAAGGTTACAACACAGCCCTT

Mouse mini-PCDH15-CD2-1-V10:                                (SEQ ID NO: 153)

ATGTTCCTACAGTTTGCTGTCTGGAAGTGTTTACCCCATGGGATCCTCATTGCCTCTCTCTTGG

TAGTCAGCTGGGGCCAGTATGACGATGACTGGCAATACGAGGATTGCAAACTAGCTAGGGGAGG

ACCACCAGCTACTATCGTGGCCATTGATGAAGAGAGTCGAAACGGTACAATTCTGGTGGATAAC

ATGTTGATTAAGGGGACTGCCGGAGGACCAGACCCCACCATAGAGCTCTCTTTAAAGGACAACG

TGGACTACTGGGTGTTGCTGGACCCCGTTAAACAGATGCTTTTCCTGAACAGTACCGGAAGAGT

TCTGGATAGAGACCCACCAATGAACATACACTCCATTGTGGTGCAAGTCCAGTGTGTCAACAAG

AAGGTTGGCACAGTTATCTATCATGAAGTACGCATCGTGGTGCGAGATCGGAATGACAACTCCC

CCACATTCAAGCATGAAAGCTACTATGCCACCGTGAATGAGCTCACTCCAGTTGGCACCACGAT

ATTCACGGGGTTCTCGGGAGACAATGGAGCTACAGACATAGACGATGGCCCTAATGGACAGATA

GAATACGTGATTCAGTACAACCCAGAAGATCCGACATCCAACGCACCTTTGAAATTCCACTCA

TGCTGACTGGCAACGTGGTACTGAGGAAAAGACTCAACTATGAGGATAAGACTCGCTACTATGT

CATCATCCAAGCAAATGACCGTGCACAAAATCTGAATGAGAGGCGAACAACCACCACCACCCTC

ACAGTAGATGTTCTAGATGGAGATGACCTGCCCCCAGTGTTCCAGAAGAAATTCTACATTGGAG

GTGTGTCTGAAGACGCAAGGATGTTCGCATCTGTGCTCAGAGTGAAGGCCACCGACAGGGACAC

-continued

GGGTAATTACAGTGCCATGGCCTACCGGCTCATCATACCGCCGATTAAAGAGGGCAAAGAGGGG

TTTGTGGTGGAAACATACACAGGTCTCATCAAGACAGCCATGCTCTTCCACAATATGAGAAGAT

CCTACTTCAAGTTTCAAGTGATTGCAACTGACGACTACGGGAAGGGGTTGAGCGGGAAAGCAGA

CGTACTGGTCTCCGTGGTCAATCAACTGGATATGCAGGTCATTGTCTCCAATGTGCCCCCTACA

CTAGTGGAAAAGAAGATAGAAGACCTTACAGAGATTTTGGATCGCTACGTTCAGGAGCAAATTC

CTGGTGCCAAGGTTGTGGTGGAGTCCATAGGTGCCCGTCGCCATGGAGACGCCTACTCCCTAGA

AGACTATAGCAAGTGCGACCTGACTGTCTATGCCATCGACCCGCAGACCAACAGAGCCATCGAC

AGAAATGAGCTTTTTAAGTTCCTGGACGGCAAACTGCTCGATATCAATAAAGACTTCCAGCCGT

ATTACGGGGAAGGAGGGCGCATTCTGGAGATTCGGACACCTGAGGCAGTGACGAGCATCAAGAA

GCGAGGAGAAAGCTTGGGGTACACAGAAGGGGCCTTGCTGGCCTTGGCCTTCATCATCATCCTC

TGTTGCATCCCAGCCATCTTGGTCGTCTTAGTAAGCTACCGACAGTTTAAAGTACGCCAGGCTG

AGTGCACGAAGACCGCAAGAATTCAGTCTGCTATGCCTGCAGCCAAGCCTGCAGCTCCTGTACC

AGCTGCGCCTGCGCCGCCCCCGCCCCCGCCACCACCACCACCAGGAGCACATCTCTATGAAGAA

CTGGAGAGAGCGCAATGCATAAGTATGAGATGCCCCAGTATGGAAGTCGCCGTCGACTGCTGC

CACCTGCTGGACAGGAGGAATACGGCGAAGTCATTGGTGAAGCTGAAGAGGAATATGAAGAAGA

AGAGGTAGAGCCAGAGAAAGTTAAAAAAACCCAAAGTTGAAATTAGAGAGCCTAGTGAGGAGGAG

GTGGTAGTCACCGTTGAGAAGCCACCAGCGGCTGAGCCCACATACCCAACGTGGAAGAGAGCCA

GGATATTCCCGATGATTTTTAAGAAAGTCAGAGGTCTCGCTGAGAAAAGAGGCATTGACCTTGA

GGGCGAGGAGTGGAGGAGGCGCCTTGATGAAGAAGACAAAGACTATCTTCAACTGACTCTAGAC

CAGGAGGAAGCTACCGAAAGCACCGTGGAGTCAGAGGAGGAGTCCAGCGACTACACAGAATACA

CAGAAACGGAGTCCGAGTTCAGCGAGTCCGAGACAACTGAAGAATCAGAGTCGGAGACCCCATC

TGAGGAAGCGGAGGAGAGCTCTACCCCGGAGTCAGAGGAGTCTGAGTCCACTGAGTCAGAGGGA

GAGAAAGCAAGAAAAAACATCGTGCTGGCTAGAAGAAGGCCTGTGGTCGAGGAAATCCAGGAGG

TGAAAGGTAAGAGAGAGGAGCCCCCGGTGGAAGAGGAAGAAGAGCCCCCACTAGAGGAGGAAGA

ACGGGCAGAGGAAGGAGAAGAAAGCGAAGCAGCTCCCATGGATGAGTCCACAGACCTGGAGGCT

CAGGATGTCCCAGAGGAGGGCAGTGCAGAATCAGTCTCCATGGAGAGGGGCGTGGAAAGTGAGG

AGTCAGAGTCAGAACTGAGCAGCAGCAGCAGTACCAGTGAGAGTCTCTCCGGAGGCCCCTGGGG

CTTTCAGGTGCCAGAATATGACAGAAGGAAGGATGAAGAGCCCAAGAAATCTCCAGGCGCAAAC

TCCGAAGGTTACAACACAGCCCTT

Full length mouse PCDH15 CD2 isoform coding sequence:

ATGTTCCTACAGTTTGCTGTCTGGAAGTGTTTACCCCATGGGATCCTCATTGCCTCTCTCTTGG                     (SEQ ID NO: 69)

TAGTCAGCTGGGGCCAGTATGACGATGACTGGCAATACGAGGATTGCAAACTAGCTAGGGGAGG

ACCACCAGCTACTATCGTGGCCATTGATGAAGAGAGTCGAAACGGTACAATTCTGGTGGATAAC

ATGTTGATTAAGGGGACTGCCGGAGGACCAGACCCCACCATAGAGCTCTCTTTAAAGGACAACG

TGGACTACTGGGTGTTGCTGGACCCCGTTAAACAGATGCTTTTCCTGAACAGTACCGGAAGAGT

TCTGGATAGAGACCCACCAATGAACATACACTCCATTGTGGTGCAAGTCCAGTGTGTCAACAAG

AAGGTTGGCACAGTTATCTATCATGAAGTACGCATCGTGGTGCGAGATCGGAATGACAACTCCC

CCACATTCAAGCATGAAAGCTACTATGCCACCGTGAATGAGCTCACTCCAGTTGGCACCACGAT

ATTCACGGGGTTCTCGGGAGACAATGGAGCTACAGACATAGACGATGGCCCTAATGGACAGATA

GAATACGTGATTCAGTACAACCCAGAAGATCCGACATCCAACGACACCTTTGAAATTCCACTCA

-continued

```
TGCTGACTGGCAACGTGGTACTGAGGAAAAGACTCAACTATGAGGATAAGACTCGCTACTATGT

CATCATCCAAGCAAATGACCGTGCACAAAATCTGAATGAGAGGCGAACAACCACCACCACCCTC

ACAGTAGATGTTCTAGATGGAGATGACCTGGGACCTATGTTTCTGCCTTGTGTTCTTGTGCCAA

ACACACGTGACTGTCGTCCACTCACCTACCAAGCTGCCATTCCTGAACTGAGGACTCCGGAAGA

ACTGAACCCTATTTTGGTGACACCACCTATCCAAGCCATTGATCAGGACCGAAACATCCAACCA

CCATCTGATCGACCTGGCATCCTCTACTCCATCCTTGTCGGCACCCCTGAGGATTACCCCCGCT

TCTTCCATATGCATCCCAGGACTGCAGAACTCACTCTCCTGGAGCCAGTAAACAGAGACTTCCA

TCAAAAATTTGATTTGGTTATTAAGGCTGAGCAGGACAATGGCCACCCACTTCCTGCCTTTGCT

AGTCTGCACATCGAAATACTAGACGAAAACAATCAGAGTCCATACTTCACAATGCCCAGCTATC

AAGGATACATCCTGGAATCCGCCCCAGTGGGAGCCACCATTTCTGAGAGCCTAAACTTAACCAC

TCCTCTGAGAATTGTAGCTCTGGACAAAGACATAGAAGACGTGCCACCTGGTGGAGTTCCTACA

AAAGATCCAGAGCTCCACCTCTTCCTGAATGACTACACCTCGGTCTTCACTGTGACACCCACTG

GTATCACCCGCTACCTCACCCTGCTTCAACCTGTGGACAGGGAGGAACAGCAAACCTACACCTT

TCTGATAACAGCGTTTGATGGCGTGCAAGAAAGTGAGCCAGTCGTGGTCAATATCCGAGTGATG

GATGCAAATGATAACACGCCCACCTTCCCTGAAATCTCCTATGATGTCTATGTTTACACAGACA

TGAGTCCTGGGGACAGCGTCATTCAGCTGACAGCGGTAGATGCTGATGAAGGCTCTAATGGGGA

GATCTCCTATGAAATACTGGTGGGGGGCAAGGGAGACTTCGTGATCAACAAGACCACAGGGCTG

GTGAGCATTGCACCAGGCGTGGAGCTGATCGTGGGACAGACGTATGCGCTCACAGTGCAGGCTT

CGGACAACGCCCCGCCTGCAGAAAGAAGGCACTCCATCTGCACAGTGTACATCGAGGTGCTTCC

TCCTAACAACCAGAGCCCTCCCCGCTTCCCGCAGCTGATGTACAGTCTGGAAGTCAGCGAGGCC

ATGAGGATCGGTGCTATTTTATTAAATCTACAGGCAACTGATCGAGAGGGAGATCCAATCACAT

ATGCCATCGAGAATGGAGACCCTCAGAGAGTTTTTAATCTTTCAGAAACCACAGGGATTCTCAG

CCTAGGGAAGGCTCTAGACCGCGAGAGCACAGACCGCTACATCCTCATCGTCACAGCCTCAGAT

GGCAGACCGGATGGAACCTCAACTGCCACTGTGAACATAGTGGTGACGGACGTCAATGACAACG

CTCCCGTGTTCGATCCCTATCTGCCCAGGAACCTCTCTGTGGTGGAGGAAGAAGCCAATGCCTT

TGTGGGTCAAGTCCGGGCAACAGACCCAGATGCTGGGATAAACGGCCAAGTTCACTACAGCCTG

GGGAACTTCAACAACCTCTTCCGCATCACATCCAACGGGAGCATTTACACAGCCGTGAAGCTGA

ACAGGGAAGCCAGGGACCACTATGAACTGGTTGTCGTGGCAACAGATGGAGCAGTCCACCCTCG

ACATTCAACTCTGACACTGTACATCAAGGTGTTGGACATTGATGATAACAGTCCTGTTTTTACC

AATTCAACGTACACAGTTGTCGTTGAAGAGAATCTGCCAGCCGGGACCTCCTTTCTTCAAATAG

AGGCCAAGGATGTTGACCTTGGAGCCAATGTGTCATATCGGATCAGAAGCCCAGAAGTGAAACA

CCTTTTTGCACTGCATCCATTCACTGGAGAATTGTCTCTTCTGAGGAGTTTGGATTATGAGGCC

TTTCCGGACCAGGAGGCAAGCATCACATTCTTGGTGGAGGCCTTTGACATTTATGGGACTATGC

CACCTGGTATAGCAACAGTCACGGTAATTGTGAAGGACATGAATGACTACCCTCCAGTGTTTAG

CAAACGCATCTACAAGGGGATGGTGGCTCCAGATGCAGTCAAGGGGACACCAATCACCACCGTT

TATGCTGAAGATGCGGACCCACCTGGGATGCCTGCAAGTAGGGTGAGGTATCGAGTGGACGACG

TGCAGTTTCCATACCCAGCCAGTATTTTTGATGTAGAGGAAGATTCTGGAAGAGTAGTAACCCG

CGTCAATCTTAATGAAGAGCCTACTACGATTTTCAAGCTGGTGGTTGTGGCTTTTGATGACGGC

GAACCTGTGATGTCCAGCAGTGCCACGGTGAGAATTCTTGTCTTACATCCTGGAGAGATCCCAC

GCTTCACCCAAGAGGAATACAGACCTCCTCCTGTAAGTGAGCTTGCGGCCAGAGGGACTGTAGT

TGGTGTCATTTCTGCTGCTGCCATTAATCAGAGCATCGTGTACTCCATTGTGGCAGGAAATGAG
```

-continued

GAAGACAAGTTTGGAATCAACAATGTCACTGGGGTCATCTATGTGAATTCACCATTGGATTACG

AGACAAGGACCAGCTATGTGCTCCGGGTACAAGCAGATTCTCTGGAAGTGGTCCTTGCCAATCT

CCGAGTCCCTTCAAAAAGCAATACAGCTAAGGTGTACATTGAGATTCAGGATGAAAACGATCAC

CCCCCAGTGTTCCAGAAGAAATTCTACATTGGAGGTGTGTCTGAAGACGCAAGGATGTTCGCAT

CTGTGCTCAGAGTGAAGGCCACCGACAGGGACACGGGTAATTACAGTGCCATGGCCTACCGGCT

CATCATACCGCCGATTAAAGAGGGCAAAGAGGGGTTTGTGGTGGAAACATACACAGGTCTCATC

AAGACAGCCATGCTCTTCCACAATATGAGAAGATCCTACTTCAAGTTTCAAGTGATTGCAACTG

ACGACTACGGGAAGGGGTTGAGCGGGAAAGCAGACGTACTGGTCTCCGTGGTCAATCAACTGGA

TATGCAGGTCATTGTCTCCAATGTGCCCCCTACACTAGTGGAAAAGAAGATAGAAGACCTTACA

GAGATTTTGGATCGCTACGTTCAGGAGCAAATTCCTGGTGCCAAGGTTGTGGTGGAGTCCATAG

GTGCCCGTCGCCATGGAGACGCCTACTCCCTAGAAGACTATAGCAAGTGCGACCTGACTGTCTA

TGCCATCGACCCGCAGACCAACAGAGCCATCGACAGAAATGAGCTTTTTAAGTTCCTGGACGGC

AAACTGCTCGATATCAATAAAGACTTCCAGCCGTATTACGGGGAAGGAGGGCGCATTCTGGAGA

TTCGGACACCTGAGGCAGTGACGAGCATCAAGAAGCGAGGAGAAAGCTTGGGGTACACAGAAGG

GGCCTTGCTGGCCTTGGCCTTCATCATCATCCTCTGTTGCATCCCAGCCATCTTGGTCGTCTTA

GTAAGCTACCGACAGTTTAAAGTACGCCAGGCTGAGTGCACGAAGACCGCAAGAATTCAGTCTG

CTATGCCTGCAGCCAAGCCTGCAGCTCCTGTACCAGCTGCGCCTGCGCCGCCCCCGCCCCCGCC

ACCACCACCACCAGGAGCACATCTCTATGAAGAACTGGGAGAGAGCGCAATGCATAAGTATGAG

ATGCCCCAGTATGGAAGTCGCCGTCGACTGCTGCCACCTGCTGGACAGGAGGAATACGGCGAAG

TCATTGGTGAAGCTGAAGAGGAATATGAAGAAGAAGAGGTAGAGCCAGAGAAAGTTAAAAAACC

CAAAGTTGAAATTAGAGAGCCTAGTGAGGAGGAGGTGGTAGTCACCGTTGAGAAGCCACCAGCG

GCTGAGCCCACATACCCAACGTGGAAGAGAGCCAGGATATTCCCGATGATTTTTAAGAAAGTCA

GAGGTCTCGCTGAGAAAAGAGGCATTGACCTTGAGGGCGAGGAGTGGAGGAGGCGCCTTGATGA

AGAAGACAAAGACTATCTTCAACTGACTCTAGACCAGGAGGAAGCTACCGAAAGCACCGTGGAG

TCAGAGGAGGAGTCCAGCGACTACACAGAATACACAGAAACGGAGTCCGAGTTCAGCGAGTCCG

AGACAACTGAAGAATCAGAGTCGGAGACCCCATCTGAGGAAGCGGAGGAGAGCTCTACCCCGGA

GTCAGAGGAGTCTGAGTCCACTGAGTCAGAGGGAGAGAAAGCAAGAAAAAACATCGTGCTAGCT

AGAAGAAGGCCTGTGGTCGAGGAAATCCAGGAGGTGAAAGGTAAGAGAGAGGAGCCCCCGGTGG

AAGAGGAAGAAGAGCCCCCACTAGAGGAGGAAGAACGGGCAGAGGAAGGAGAAGAAAGCGAAGC

AGCTCCCATGGATGAGTCCACAGACCTGGAGGCTCAGGATGTCCCAGAGGAGGGCAGTGCAGAA

TCAGTCTCCATGGAGAGGGGCGTGGAAAGTGAGGAGTCAGAGTCAGAACTGAGCAGCAGCAGCA

GTACCAGTGAGAGTCTCTCCGGAGGCCCCTGGGGCTTTCAGGTGCCAGAATATGACAGAAGGAA

GGATGAAGAGCCCAAGAAATCTCCAGGCGCAAACTCCGAAGGTTACAACACAGCCCTTTAG

Full length mouse PCDH15 CD2 isoform amino acid sequence:

(SEQ ID NO: 70)

MFLQFAVWKCLPHGILIASLLVVSWGQYDDDWQYEDCKLARGGPPATIVAIDEESRNGTILVDN

MLIKGTAGGPDPTIELSLKDNVDYWVLLDPVKQMLFLNSTGRVLDRDPPMNIHSIVVQVQCVNK

KVGTVIYHEVRIVVRDRNDNSPTFKHESYYATVNELTPVGTTIFTGFSGDNGATDIDDGPNGQI

EYVIQYNPEDPTSNDTFEIPLMLTGNVVLRKRLNYEDKTRYYVIIQANDRAQNLNERRTTTTTL

TVDVLDGDDLGPMFLPCVLVPNTRDCRPLTYQAAIPELRTPEELNPILVTPPIQAIDQDRNIQP

PSDRPGILYSILVGTPEDYPRFFHMHPRTAELTLLEPVNRDFHQKFDLVIKAEQDNGHPLPAFA

SLHIEILDENNQSPYFTMPSYQGYILESAPVGATISESLNLTTPLRIVALDKDIEDVPPGGVPT

KDPELHLFLNDYTSVFTVTPTGITRYLTLLQPVDREEQQTYTFLITAFDGVQESEPVVVNIRVM

DANDNTPTFPEISYDVYVYTDMSPGDSVIQLTAVDADEGSNGEISYEILVGGKGDFVINKTTGL

VSIAPGVELIVGQTYALTVQASDNAPPAERRHSICTVYIEVLPPNNQSPPRFPQLMYSLEVSEA

MRIGAILLNLQATDREGDPITYAIENGDPQRVFNLSETTGILSLGKALDRESTDRYILIVTASD

GRPDGTSTATVNIVVTDVNDNAPVFDPYLPRNLSVVEEEANAFVGQVRATDPDAGINGQVHYSL

GNFNNLFRITSNGSIYTAVKLNREARDHYELVVVATDGAVHPRHSTLTLYIKVLDIDDNSPVFT

NSTYTVVVEENLPAGTSFLQIEAKDVDLGANVSYRIRSPEVKHLFALHPFTGELSLLRSLDYEA

FPDQEASITFLVEAFDIYGTMPPGIATVTVIVKDMNDYPPVFSKRIYKGMVAPDAVKGTPITTV

YAEDADPPGMPASRVRYRVDDVQFPYPASIFDVEEDSGRVVTRVNLNEEPTTIFKLVVVAFDDG

EPVMSSSATVRILVLHPGEIPRFTQEEYRPPPVSELAARGTVVGVISAAAINQSIVYSIVAGNE

EDKFGINNVTGVIYVNSPLDYETRTSYVLRVQADSLEVVLANLRVPSKSNTAKVYIEIQDENDH

PPVFQKKFYIGGVSEDARMFASVLRVKATDRDTGNYSAMAYRLIIPPIKEGKEGFVVETYTGLI

KTAMLFHNMRRSYFKFQVIATDDYGKGLSGKADVLVSVVNQLDMQVIVSNVPPTLVEKKIEDLT

EILDRYVQEQIPGAKVVVESIGARRHGDAYSLEDYSKCDLTVYAIDPQTNRAIDRNELFKFLDG

KLLDINKDFQPYYGEGGRILEIRTPEAVTSIKKRGESLGYTEGALLALAFIIILCCIPAILVVL

VSYRQFKVRQAECTKTARIQSAMPAAKPAAPVPAAPAPPPPPPPPPPGAHLYEELGESAMHKYE

MPQYGSRRRLLPPAGQEEYGEVIGEAEEEYEEEEVEPEKVKKPKVEIREPSEEEVVVTVEKPPA

AEPTYPTWKRARIFPMIFKKVRGLAEKRGIDLEGEEWRRRLDEEDKDYLQLTLDQEEATESTVE

SEEESSDYTEYTETESEFSESETTEESESETPSEEAEESSTPESEESESTESEGEKARKNIVLA

RRRPVVEEIQEVKGKREEPPVEEEEEPPLEEEERAEEGEESEAAPMDESTDLEAQDVPEEGSAE

SVSMERGVESEESESELSSSSSTSESLSGGPWGFQVPEYDRRKDEEPKKSPGANSEGYNTAL

Mouse TM + CD1 cytoplasmic domain coding sequence:

(SEQ ID NO: 154)

GGGGCCTTGCTGGCCTTGGCCTTCATCATCATCCTCTGTTGCATCCCAGCCATCTTGGTCGTCT

TAGTAAGCTACCGACAGTTTAAAGTACGCCAGGCTGAGTGCACGAAGACCGCAAGAATTCAGTC

TGCTATGCCTGCAGCCAAGCCTGCAGCTCCTGTACCAGCTGCGCCTGCGCCGCCCCCGCCCCCG

CCACCACCACCACCAGGAGCACATCTCTATGAAGAACTGGGAGAGAGCGCAATGCATAATCTTT

TCCTTCTCTACCATTTTGAACAAAGCAGGGGAAATAACTCAGTCCCAGAAGACAGGAGCAGTCA

TCGCGATGGGATGGCCTTTTCCTCCAGTACCACTGAGTCTCATGAGCCAGCTCATGTAGAGGGA

CCACTTAAGGAGAGCCAGCCTAACCCAGCAAGGACGTTCTCATTTGTTCCTGATGAGGATAACT

TAAGTACCCATAATCCCCTTTACATGGAAAGTATAGGTCAAAGGTCAACAAACTCAGACCTTCA

GCCACGAACAGATTTTGAAGAGCTGTTGGCACCCAGAACACAAGTTAAGAGTCAGTCTCTGAGG

GGCCCAAGAGAAAAGATCCAGAGGGTGTGGAATCAGTCTGTGAGCTTTCCTAGGCGGCTCATGT

GGAAAGCCCCAAACAGGCCAGAGACCATAGACCTGGTGGAGTGGCAGATCACCAATCAGAGAGC

TGAATGCGAAAGCGCCAGATGCCACCCAAGCCAGAGAGGTAGCAGCAACGTTCTGCTGGCAACT

GAAGATGCCCACGAGTCAGAGAAAGAAGGGGGACACAGAGACACCCTAATCGTCCAGCAAACAG

AGCAGCTGAAATCTCTGTCTTCTGGCTCTTCTTTTTCCTCCTCTTGGTCTCACTTTTCTTTCTC

AACTCTGCCAACGATTTCCAGAGCGGTGGAACTCGGGTCGGAACCTAATGTGGTCACTTCTCCC

GCTGACTGCACCTTGGAACTTTCTCCTCCTCTGAGACCCCGTATTTTAAACTCCTTAAGCTCTA

AGAGAGAGACTCCCACATGTGCATCAGATACAGAACCAAAAAGGAACTCTTTTGAGATCGCTCC

CCATCCACCTAGCATCTCTGCTCCCCTCCCACATCCGCCTCTTCCTAGACCTCCCATTGCCTTT

-continued

ACCACTTTTCCTCTTCCCCTTTCTCCCCCTAACCCTCCTCCCCCACAACTTGTTACATTTTCTC

TTCCCATTTCTACACCCCCTACTTCTTCTCTACCTCTTCCTCCTCCACTGTCACTTCCTCCTCC

TCCTCGGCCACCAGCTCCCCGCCTCTTCCCACAGCCTCCTTCCACGTCCATTCCATCCACAGAC

AGCATCTCTGCACCAGCTGCTAAATGCACTGCCAGTGCCACACACGCCAGAGAAACCACGTCTA

CGACACAGCCACCAGCATCCAACCCGCAGTGGGGGGCAGAACCCCACAGACATCCAAAAGGGAT

CCTCAGACATGTGAAAAACTTGGCAGAGCTCGAGAAATCAGTGTCTAACATGTACAGTCACATA

GAAAAAAACTGCCCACCTGCAGATCCCTCAAAACTACACACGTTTTGCCCTGCAGAGAAACAG

GCATGAAAATCACACATGACCAGAGCCAGGAAACGTTGGTTAGAGTTGTTGAGGGAATTGACGT

GCAACCTCACAGTCAATCAACATCTTTGTAA

Mouse TM + CD2 cytoplasmic domain coding sequence:

(SEQ ID NO: 155)

GGGGCCTTGCTGGCCTTGGCCTTCATCATCATCCTCTGTTGCATCCCAGCCATCTTGGTCGTCT

TAGTAAGCTACCGACAGTTTAAAGTACGCCAGGCTGAGTGCACGAAGACCGCAAGAATTCAGTC

TGCTATGCCTGCAGCCAAGCCTGCAGCTCCTGTACCAGCTGCGCCTGCGCCGCCCCCGCCCCCG

CCACCACCACCACCAGGAGCACATCTCTATGAAGAACTGGGAGAGAGCGCAATGCATAAGTATG

AGATGCCCCAGTATGGAAGTCGCCGTCGACTGCTGCCACCTGCTGGACAGGAGGAATACGGCGA

AGTCATTGGTGAAGCTGAAGAGGAATATGAAGAAGAAGAGGTAGAGCCAGAGAAAGTTAAAAAA

CCCAAAGTTGAAATTAGAGAGCCTAGTGAGGAGGAGGTGGTAGTCACCGTTGAGAAGCCACCAG

CGGCTGAGCCCACATACCCAACGTGGAAGAGAGCCAGGATATTCCCGATGATTTTTAAGAAAGT

CAGAGGTCTCGCTGAGAAAAGAGGCATTGACCTTGAGGGCGAGGAGTGGAGGAGGCGCCTTGAT

GAAGAAGACAAAGACTATCTTCAACTGACTCTAGACCAGGAGGAAGCTACCGAAAGCACCGTGG

AGTCAGAGGAGGAGTCCAGCGACTACACAGAATACACAGAAACGGAGTCCGAGTTCAGCGAGTC

CGAGACAACTGAAGAATCAGAGTCGGAGACCCCATCTGAGGAAGCGGAGGAGAGCTCTACCCCG

GAGTCAGAGGAGTCTGAGTCCACTGAGTCAGAGGGAGAGAAAGCAAGAAAAAACATCGTGCTGG

CTAGAAGAAGGCCTGTGGTCGAGGAAATCCAGGAGGTGAAAGGTAAGAGAGAGGAGCCCCCGGT

GGAAGAGGAAGAAGAGCCCCCACTAGAGGAGGAAGAACGGGCAGAGGAAGGAGAAGAAAGCGAA

GCAGCTCCCATGGATGAGTCCACAGACCTGGAGGCTCAGGATGTCCCAGAGGAGGGCAGTGCAG

AATCAGTCTCCATGGAGAGGGGCGTGGAAAGTGAGGAGTCAGAGTCAGAACTGAGCAGCAGCAG

CAGTACCAGTGAGAGTCTCTCCGGAGGCCCCTGGGGCTTTCAGGTGCCAGAATATGACAGAAGG

AAGGATGAAGAGCCCAAGAAATCTCCAGGCGCAAACTCCGAAGGTTACAACACAGCCCTT

Mouse TM + CD3-1 cytoplasmic domain coding sequence (includes coding and non-coding regions):

(SEQ ID NO: 156)

GGGGCCTTGCTGGCCTTGGCCTTCATCATCATCCTCTGTTGCATCCCAGCCATCTTGGTCGTCT

TAGTAAGCTACCGACAGTTTAAAGTACGCCAGGCTGAGTGCACGAAGACCGCAAGAATTCAGTC

TGCTATGCCTGCAGCCAAGCCTGCAGCTCCTGTACCAGCTGCGCCTGCGCCGCCCCCGCCCCCG

CCACCACCACCACCAGGAGCACATCTCTATGAAGAACTGGGAGAGAGCGCAATGCATAAGTATG

AGATGCCCCAGTATGGAAGTCGCCGTCGACTGCTGCCACCTGCTGGACAGGAGGAATACGGCGA

AGTCATTGGTGAAGCTGAAGAGGAATATGAAGAAGAAGAGTGGGCAAGAAAAAGAATGATCAAG

TTGGTGGTCGATCGGGAGTATGAGAGCAGCTCACCTGGGGAAGACAGCGCTCCTGAGTCGCAGA

GAAGCAGAACTCACAAGCCCAGTGGCCGCAGCAATGTCAACGGCAACATCTACATTGCGCAGAA

TGGTTCCGTGGTGAGAACACGCCGTGCCTGCGTCGCTGATAACTTGAAGGTGCCCTCCCCTGGG

TTGCTTGGGAGGCATCTGAAGAAATTAGACACATTGGCAGGGACACGTGAAGAGAATGTGCCCC

-continued

```
TGAACACACTGTTCAAGGGGCCATTTTCCACAGAGAAAGCGAAAAGAACCCCAACTCTGGTCAC

GTTTGCCCCGTGCCCCGTGGTGGCTGAGCACTCGGCAGTGAAGCCATCAGGGACCAGGCTGAAA

CACACAGCTGAGCAGGAGTCCATGGTAGACAGTAGGCTCTCCAGAGAGTCGATGGAATTCCACG

GTGACAGCGCGCCATCAGATGAGGAGGAGCTCTGGATGGGTCCGTGGAACAGCCTCCACATACC

AATGACAAAACTCTGACCAATACAAAGAATAACTTCGTTTTTACTTGTTTTTAATGAACTCTGC

TTTTTATTGTCTCAAAAATCAACATATGGGGTTTATCACATGTGCACAACCTAACACTTCGAAT

GATCTGCTTTACAATAAAAGAGAAAGAGAGAGATCATTTGTATCAATTAATTGTTAGCCCCAGA

AAAGCCTTTGTGGACAGACAGAAATCACTAAGTAACATCACTTCAAAGTCTAGTTGTTTGGTTG

GATCTTGAATTAGTCTTTTCCATTGTAATAAGCAAGGAATAACTTAGTAGAAATCATTTATATT

TTTTGCTTAACATAGATTGTACTCCATTTCTAGGTTGACAGCACATTTTTCCGCACATGTAATT

TTATTTTCTATGGGGTAACAGATTTTTATAGGTATGAGATTTATACAGCTACTGTCTGTACTGT

GCTGACTTTATAAAAGAAAAATAGGCTTACAAAGCAGCAGTCCAGGTGGGAATCACTTGTAAGT

TATTTTCAATCCTGAAGTTACATAGTATCCACAATGTAGTTTTAAAGATTTTTGAAGGAATACT

TGTGGCCTTAGGAAGAACATTCGAGGTCAATGCTTTTATAAAAACAAAAAAAAAAAAAAAAAAAC

CAAAAAACAAAAAACACATAATTTACCGTTTTACCTGGCACACACCCCACATGTATCTGCATAT

ATTCTATCCATTCCACATGGAGCAAATAATTTACCAACTTTTGCAAGTCAGTAACTGTTTGAAG

CAACATATAAACCCCACTCTCAACAAAAGCTTAGTGAGGAGTAGGGAGGGGCAAGTGGACAGCA

AAGCTTCTCGAACCCATGGTCAGTGGATGACGTAGCAAGGCGGAGGAGTCTCGCCTAATGTGAC

TAGACAGGAATCCCTTATAAGCCCAGCATACAAGGATGTGTCGGGGTCACAGGCTTATACAATG

TGTTAACCTCCTATCTATCTATCCAGGCTGCAATTCCACAGCTTCATTGCACTGGAGCACTTCA

TTTCTCCCAGCTCTCATTTATTGATAGATGACTTTAGTGCACATATTTATGTGCTATGGTCCAG

AGCCAGAAAACGATTGTCTGCACATTTGTTTTAATCAAAGAACATGATCTTCATTTTTCCACCT

CTGAACAGAAGACACAGTGTTTTGCCATTAGTAGAAACTAAACAAAATGGCCTTTAAAAATTGC

CTTGTGTGTTGCCTATTCTGCAGCATTAGAAAGGATGACCAATGTAGTCTAAGGGGCTTCAGAA

TTTTATTGAATATGTCTTAGTGTGATATAGATATATTTTGCTTCAAATTTGGCATTGTACTGAG

CGAGTTCATATGTCAATTAAATTCCTTTGGGCATGTTTATCATGTGGTTGAAGAACTGAATAGC

CTGTTATTATTACTGCCTTTACGTGGTTCAGATTATAAAATGGTTTTTACAATGTTATTTTCTC

ATTTGCAAGGTGAAGGAATTATATTTAGCGACTCACCAATTTCTGTGACTAGTATGTTTTCATT

TCAGATATGTGAACATACTTGGAGGAATATCCTGAAATCTCATTTTACTGGGAATCAATTCCTT

TTTATACCCTTAGAAAACCCATCAGCATTAGTAGTAATGTTAGAACTGTAGAGTCATGTCCACA

CCCACAGGCTTACTAACAAGGAGGTACGCCTTCACAATATGTAAGATGGCTTGCATGCATATTG

AAGTTTATGAAGCAATGTACGGCCAGTCCTTCAGGCACCAAAGCAATTTTTTTGTTACATAAAA

TATTTCATATAGATCTCAAATTAAGCATTCATACTTCCCTACTAGCTCAGTCATTGATCACTAA

ATATAATTTAATATTTTATGACATTTCATGGTAATGATTACTAGGCTCCCTTGGTATTCTTTGT

ACATACAGATCTGTATTTTTTGCCCTTCCTTTAGCTTCTAGATGTAAATGTTAACTTATATGTT

GCTGTTCCTCTCACAGTTGGGTTTTTTTTCCTTTCAGCCAAGGTTTCTATGTTCTGGTAAGGAA

GTTTGTTTTGATTATTGCTATTGAAAAAAAAACTTAAGATGGGGTAAGATAGGAGAACTTCAT

AAAAAGCTGTGTGGATCTTGGAAAATTTCTGTGGCCACTGTTAATATATGAGCAGAGTTCCAAA

GGCTAGTGTCATAACATGATAGAAAACATGGTATTTTCAAGATCACACACTGTAAGACAATATG

CAGCTATTAAAACCCAGGGGGCCATTCCGATTTCAGCACTTATAAGATGATCGTTCTGATATAA
```

-continued

```
ATGATCCTGAAGCTAATCTATTCCTGGGGTGAGATAAAGATGAGCAGCCTTGATGGGGAACAAC

CAAATCAAATATTTGGTTTGTGTATTTGAAGGAAAGAGACAGCCCTAAAACGCTGGCTGAATAA

ATCTGGATTAGCTGAAGCACTACACTCACAGGACTTTAAATAACCCATGAAATCTGGACTCATG

ATTAAAACTGCAAAGCACAGGGGAAATATGTAGGTACTGTTAGTCTTAAAAAGAATTAACATAG

ATAGTATTTACATGGAAGTATATATAAGGAAATTTGTGCCTGGTTTTCCTAGAAGGGCATGAGA

AGTTTCTTTAGCTTTTGTTCTTAATAAATACCAGCCTTCACTAAGGGGAAATAAAGCAAACAAA

TAAACCCTGCCGTTCCTAATGAACCAACATACACAGCAAATACCATCACAGTCCTGTTGTAACC

TGAGATTTCCGAAGCCTTGTGGACACTAAATTCAAGGAAGAAGCAGAGCAGTCAGTGTGGCAAG

GTACTGGTCACCCTGTGACCATTAGCCCATGGTGTCCTCCAAGTGTCTAGATTTATTCTTCTCA

TTGACTGAAAACCCTAAGAGCTGTCACAGAATTCCAACTGAATAGCATCCCAAAGGACCTTCTT

AAAGTACAGGAAACGGCTGTCCTGAGGTCCCCACTGTCAGCAATGATGTTAAAACATGTTTGCC

CTCTGTGGGTCTTCCAAACAGTCACTGCAGCTACAATCAAAATGTTGCTGATAACACTTATGTA

TCAGAAAGCAAGAAGTCATTGGATATTAATTCATGAAAGGAGCCATCGTCTTTCTTCCTTTCAC

AGATCTTCTTTAATCTCTCATTCTGTTTTATTCATTCATTGCCTTATACTATACACAGTAAGTA

GAACTTCCACAGTCCTTTAGTTCAATGGTGAGATGGGCAGAAAGCACTAAGACTCTATTCTCAG

GACAGATGCCTCCTGTGCCTGTAAATGCCACAGTGGTGCATCTGAAGGGTAAGTTCAAATAGTA

TCTAGGACTCTATTTCCTATAGAAAGTTTCTCCCTATTCCAGGGTGATAACATGAATTTCTTGT

TGTATTTCTCTCTTGTTTTAGCAGTAGCTGATTCTGTTTACTTTGGTTTTTTTTCCATTGAAGT

CTTAAGTTTATGGCAAGTTAATCACGTGTATGAAAAATGTGAACGTTGTCTATAGTTTGAGAAA

TTATCAGGACATCCACATTTTCCCAATTTCTTTACCGAAATGACTGTTCTTCCTTAAATGTTAC

GTTAAGGTATGAAGAAAATCAAGTATAAAGTCTGGGTTAAAATACATTGTTATACAATTACACA

ATGTTTTACAAATAAATTTCTTTTTGAAAAAAAAAAAAAAAAAAAAAA
```

Each construct was evaluated for proper membrane targeting and proper position of the extracellular domain outside of the cell, using live-cell labeling with an antibody to the PCDH15 N-terminal (EC1). An antibody was raised against amino acids 80-96 of PCDH15, within EC1.

Figure 1G:
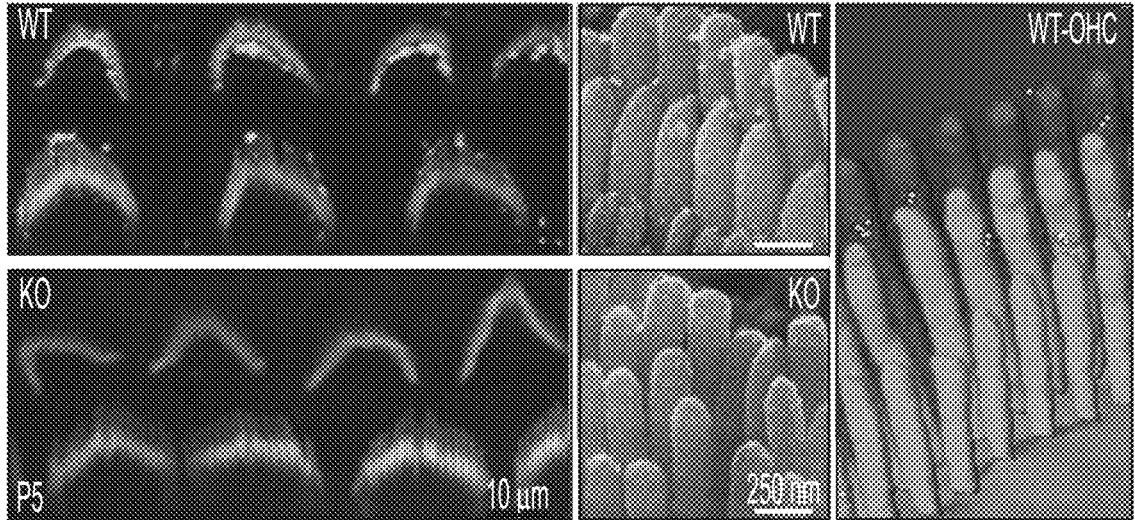
FIG. 1G shows validation of Pcdh15fl/flxGfi1-Cre KO mouse and PCDH15 antibody. An antibody was raised against amino acids 80-96 of PCDH15, within EC1. Left panel shows hair bundles from WT and KO mice, with actin label and antibody to PCDH15. Bundles in the KO are disorganized, and show no antibody label at P5. Middle panel shows immunogold SEM of a hair bundle in WT and KO mice. Gold beads (white dots) showing antibody label are absent in the KO, and stereocilia have disorganized heights. Right panel shows FIB-SEM 3D reconstruction of immunogold (dots) in a WT OHC.

Antibodies were previously validated using both fluorescence and electron microscopy immunolabeling in a Pcdh15-null mouse (FIG. 1G).

Figure 1H:
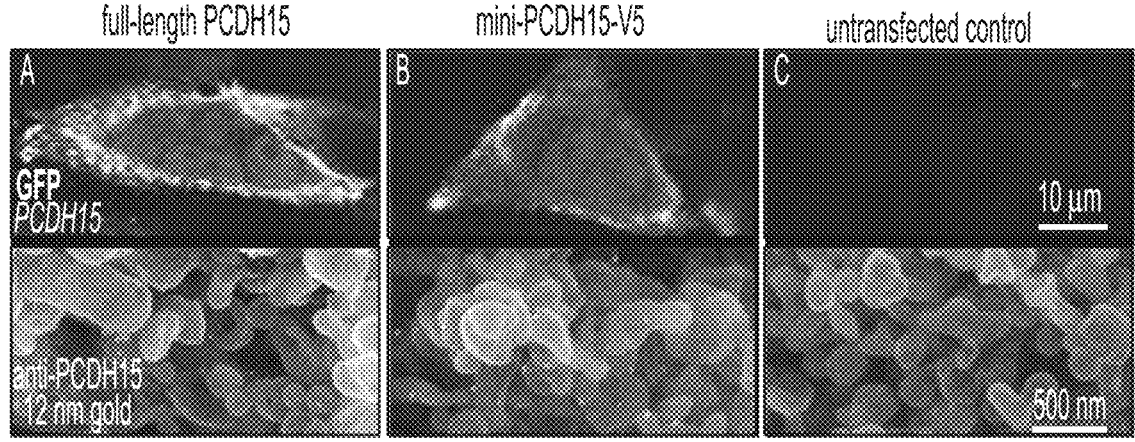
FIG. 1H shows expression of mini-PCDH15 in CHO cells. Left panels show full-length PCDH15 is located near the membrane. Antibody label of live cells before fixation, detected with SEM immunogold (white dots), shows the N-terminal epitope is extracellular. Middle panels show a mini-PCDH15 (v5) also goes to the surface and has an extracellular N-terminus. Right panels show an untransfected control.
Figure 1:
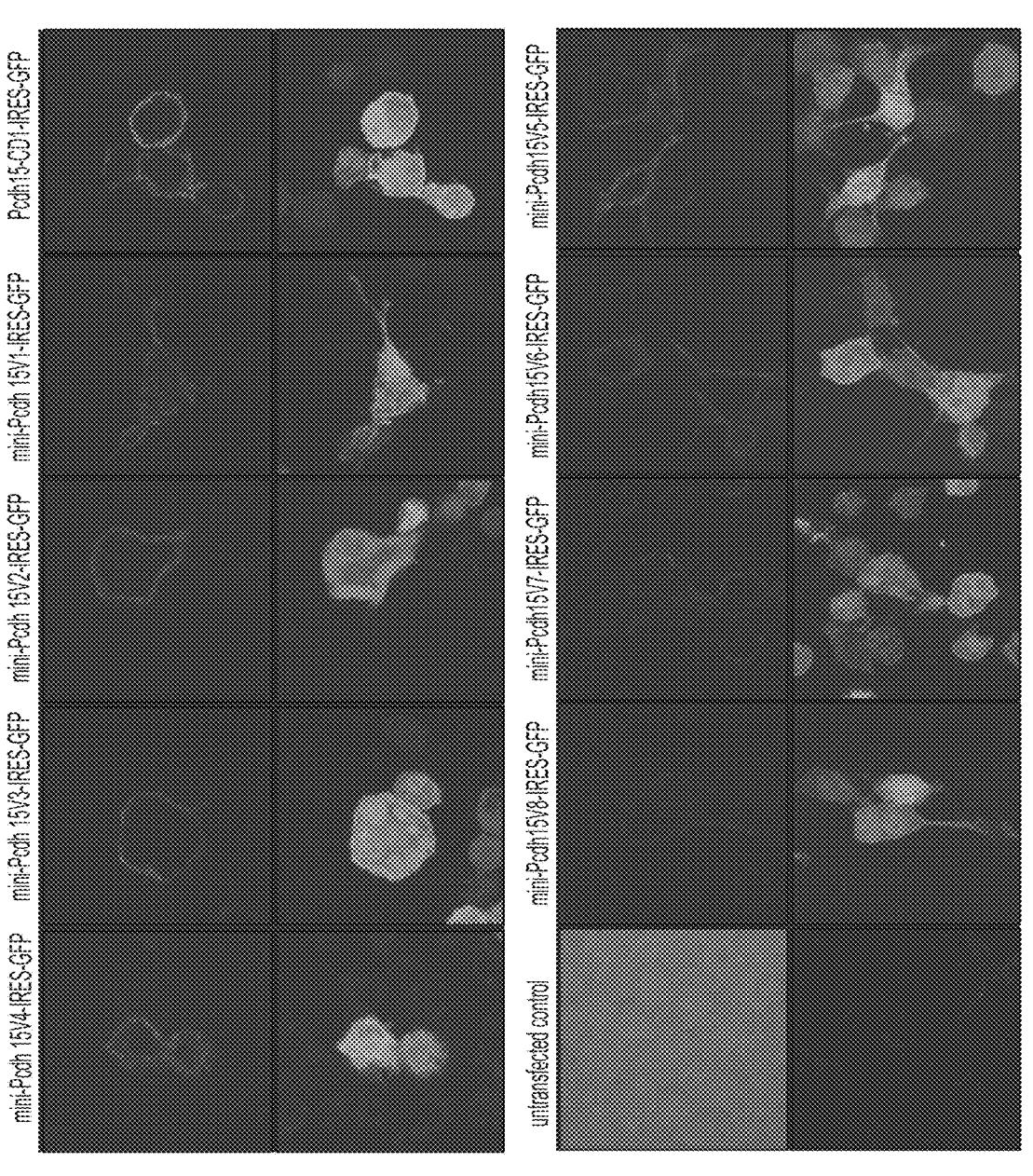
FIG. 1I shows full length PCDH15 and mini-PCDH15s are expressed in HEK cells with reasonable efficiency, and transported to the cell membrane.
FIGS. 1J-1K shows full length Pcdh15-CD1, Pcdh15-CD2 and mini-Pcdh15s transport to the cell membrane, and have EC domains positioned extracellularly as in the native protein.
FIG. 1L shows cells expressing full length PCDH15-CD1, or mini-PCDH15s bind to cells expressing CDH23 as the native proteins in the hair cell.
FIG. 1M shows immunofluorescence and immunogold localization of mini-PCDH15s. Full-length Pcdh15-CD1, mini-Pcdh15s are transport to the cell membrane, and have EC domains positioned extracellularly as in the native protein.
FIG. 1O shows SEM photomicrographs of Pcdh15fl/fl,Gfi1-Cre+(left) and Pcdh15fl/fl,Gfi1-Cre- (right) OHCs stereocilia bundles at P1 (upper) and P5 (lower).

Eight mini-PCDH15-IRES-GFP constructs were tested in cells shown to have no native PCDH15 expression (HEK293 and CHO cells). Pcdh15-CD1-IRES-GFP and mini-Pcdh15-IRES-GFP constructs were successfully transfected in HEK cells. GFP signal were used to identify transfected cells, while the anti-Pcdh15 antibody labeling against a common region of Pcdh15 (EC1-EC2) showed a cell membrane labeling pattern. Non-transfected control (bottom right panels) showed no signal for anti-PCDH15 antibody binding, confirming the antibody specificity. The presence of untransfected HEK cells is confirmed using brightfield imaging. All but one have shown significant expression levels in CHO cells, with the V5 variant reporting the highest expression levels (FIG. 1H and FIG. 1I).

Figure 1J:
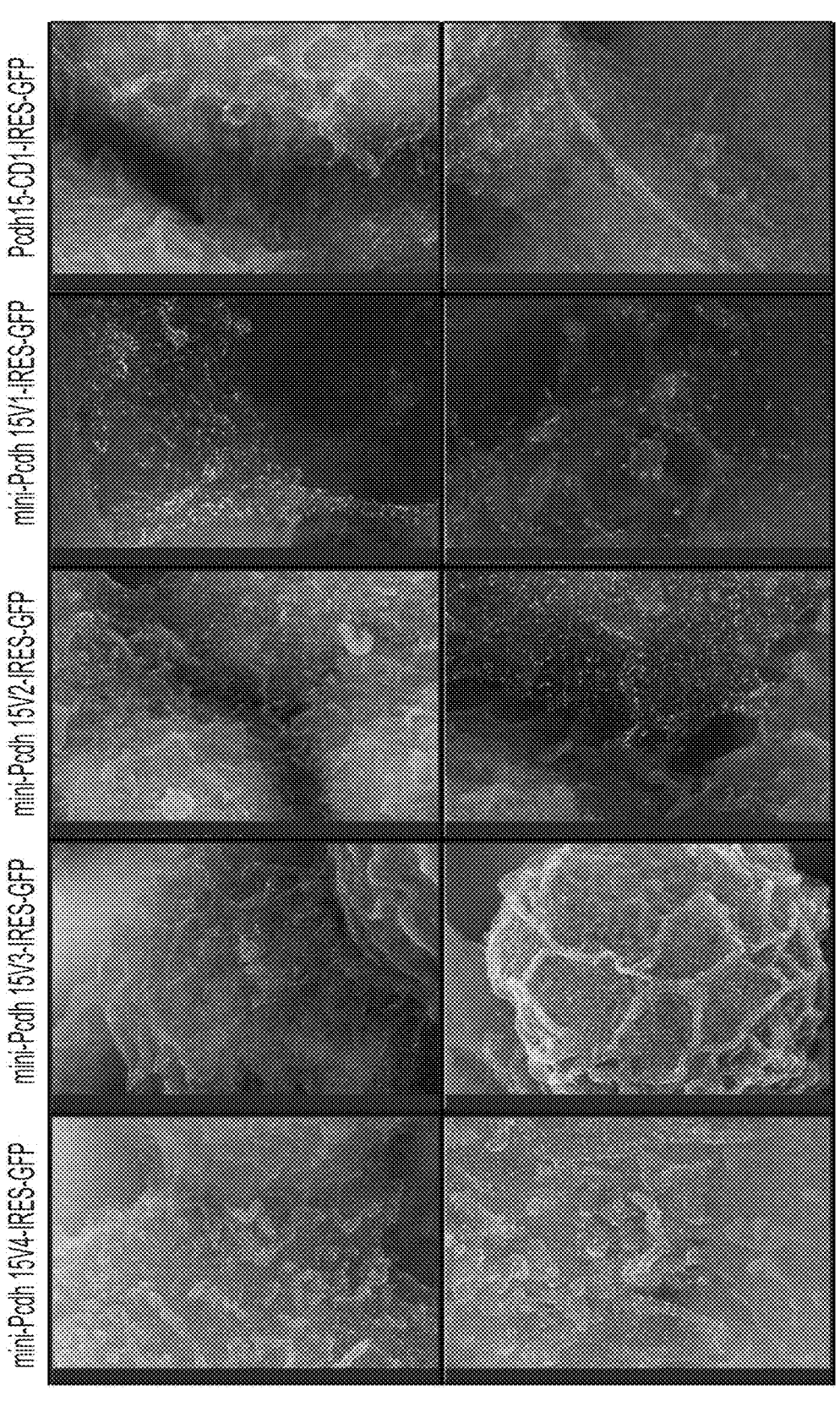
Figure 1K:
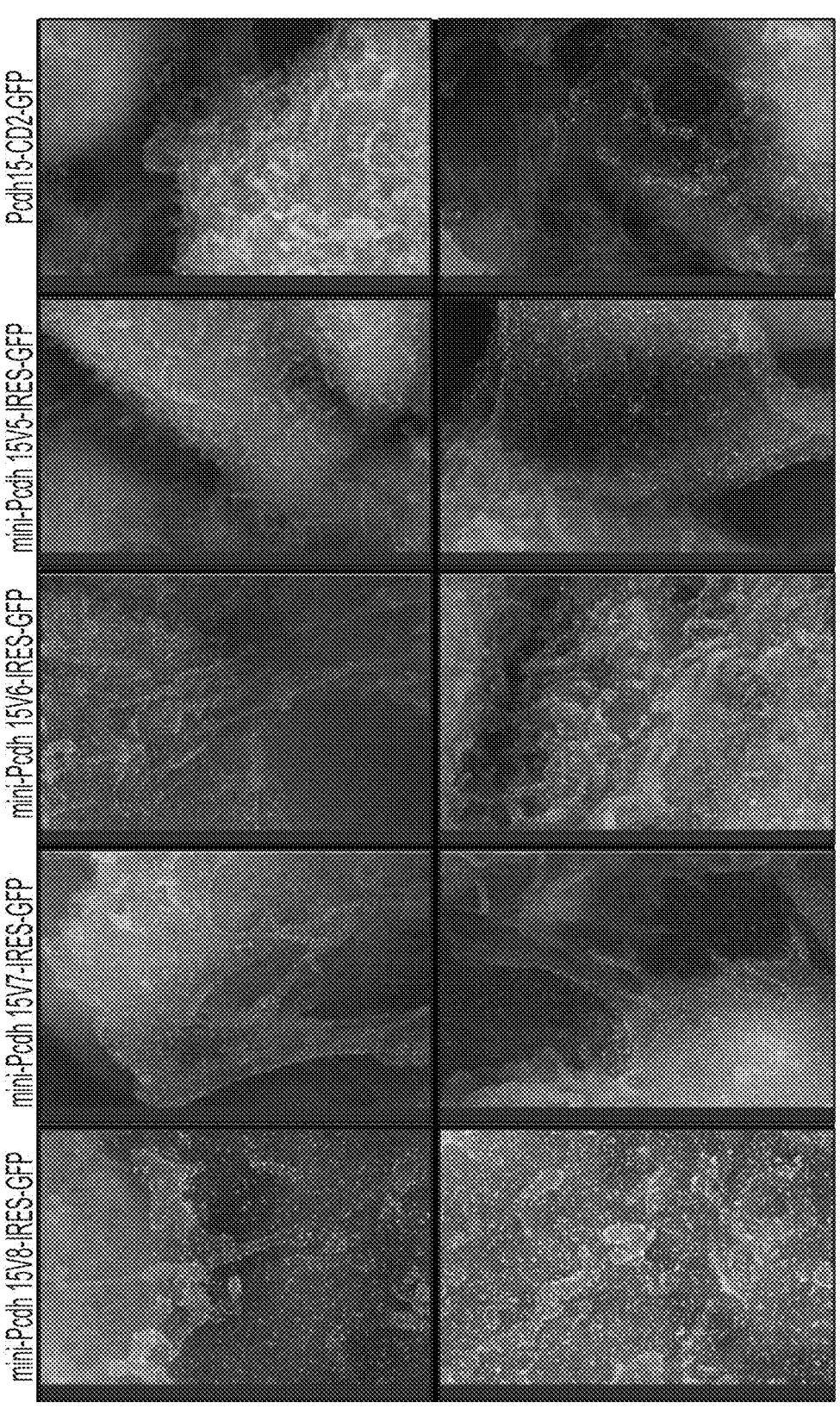
Figure 1L:
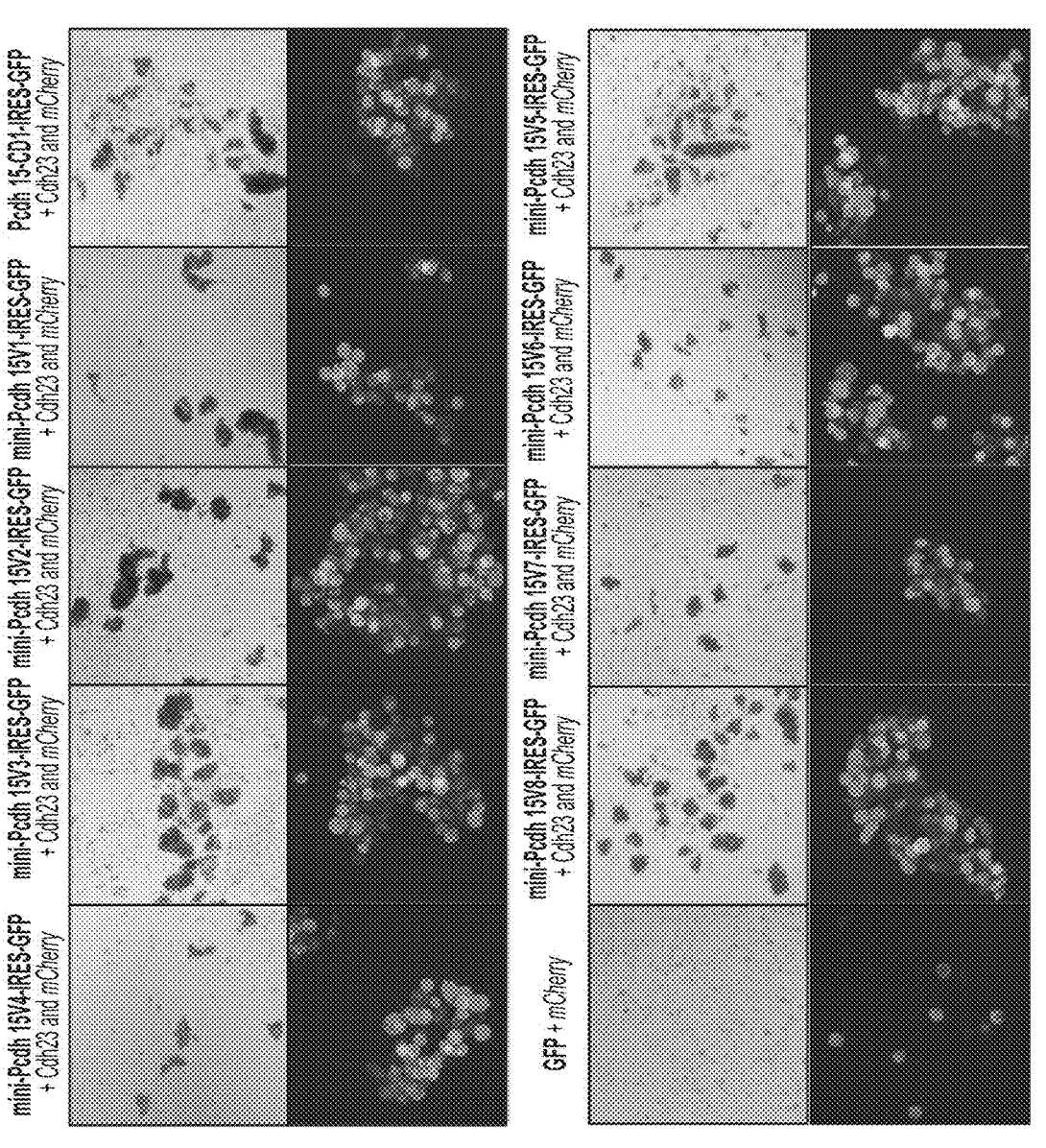
Figure 1M:
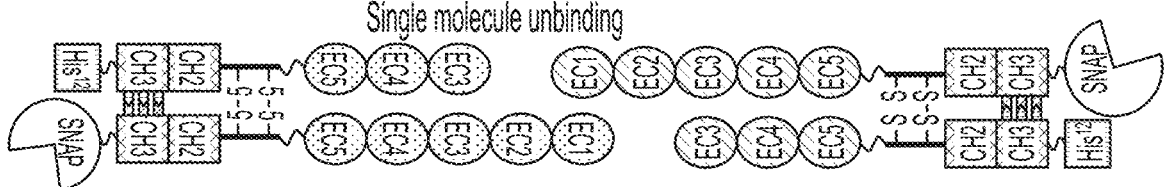
Figure 1M:
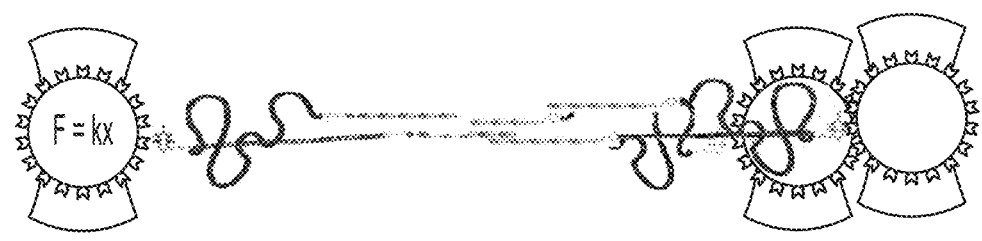
Figure 1M:
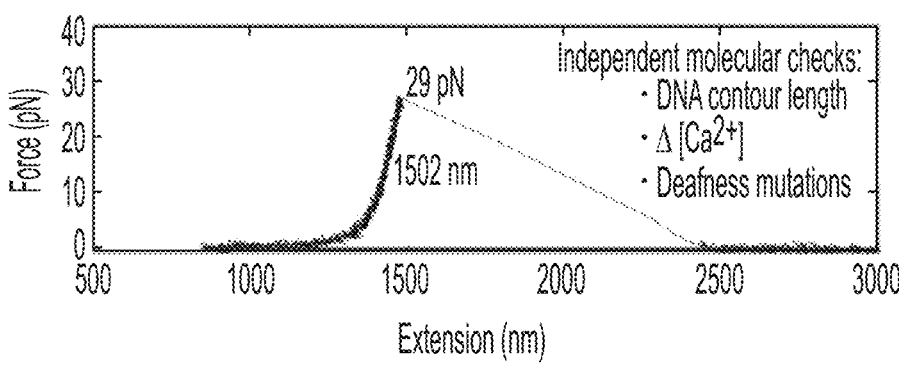

To determine whether AAV-delivered mini-PCDH15 is trafficked to the correct location and forms tip links, fluorescence confocal and immunogold scanning electron microscopy (SEM) were used, with our antibody to the N-terminus. If the PCDH15 N-terminus is properly extracellular, the N-terminal antibody would label live cells. If properly trafficked and functional in hair cells, mini-PCDH15 should be located at the tips of all but the tallest stereocilia of a hair bundle and tip links should be observed in SEM. HEK cells were transfected with eight mini-PCDH15s and with wild-type PCDH15 (control) to express successful mini candidates and test whether the PCDH15 N-terminus is properly extracellular. Fluorescence confocal and immunogold electron microscopy were used, with an antibody to the N-terminus to determine location of the protein. All these mini-PCDH15s were properly targeted to the plasma membrane (FIG. 1M).

Further, HEK cells were transfected with either Pcdh15-CD1, Pcdh15-CD2, or mini-Pcdh15 variants then labeled with 12 nm gold particles (bright dots on the images) using anti-Pcdh15 antibody. Scanning electron microphotographs report high surface labeling density in cells transfected with native Pcdh15 and all mini-Pcdh15 variants, with in-frame untransfected control cells free of labels. This result suggests efficient transport of Pcdh15 variants to the cell membrane, and indicates proper positioning of the EC domains extracellularly similar to native Pcdh15 in hair cells (FIG. 1J).

Full length Pcdh15-CD1 and mini-PCDH15 variants were then individually expressed in HEK-NC cell line lacking N-Cadherin (Yamagata et al., 2018), mixed with an equal number of HEK-NC cells expressing CDH23, and incubated on a rotating shaker at 100 rpm for 12 hours. PCDH15 expressing cells also expressed GFP, while CHD23 transfected cells were co-transfected with mCherry. Aggregates were observed using bright field microscopy to access their size (left panels), followed by fluorescence microscopy to evaluate the cell composition of the aggregates. In all cases, the aggregates report heteromeric interaction between PCDH15 and CHD23, but not controls, expressing only GFP and mCherry (bottom right panel), suggesting mini-Pcdh15 variants successfully bind Cdh23 and are likely to form tip links when expressed in hair cells (FIG. 1K).

Kinetics of PCDH15-CDH23 binding with biolayer interferometry, and zero-force off rates that match those calculated from single-molecule force spectroscopy were measured. Biolayer interferometry can quantify protein-protein interaction kinetics under 'zero force' conditions. A "bait" protein (CDH23) is immobilized on the surface of the optical sensor, and the sensor is then incubated with "prey" binding partners (cell lysate with mini-PCDH15 variants). Protein-protein interaction is read out as an optical interference signal. On- and off-rates will be analyzed to calculate binding affinity. Because the PCDH15-CDH23 interaction is Ca2+ sensitive, whether mini-PCDH15 constructs have the same Ca2+ sensitivity will be assessed. As an additional control would be PCDH15-R113G, a deafness mutant with impaired binding to CDH23.

Single-molecule force spectroscopy is used to test the strength of binding between mini-PCDH15 variants and CDH23. PCDH15 is immobilized on PEG-passivated glass beads using a covalent SNAP linkage, and CDH23 is similarly attached to beads. Using laser tweezers, a pair of beads are brought together, allow a bond to form, and then separate the beads until the cadherins unbind, measuring unbinding force (FIG. 1L). In this way, whether the mini-PCDH15-CDH23 bond can withstand similar forces as that of wt PCDH15-CDH23 is tested. To measure the unfolding strength of individual mini-PCDH15 proteins, N- and C-termini of mini-PCDH15 extracellular domains to are attached different glass beads, and pull to measure the unfolding force. Successful mini-PCDH15s will unfold at forces equal to or near the full-length PCDH15 extracellular domain.

Figure 4:
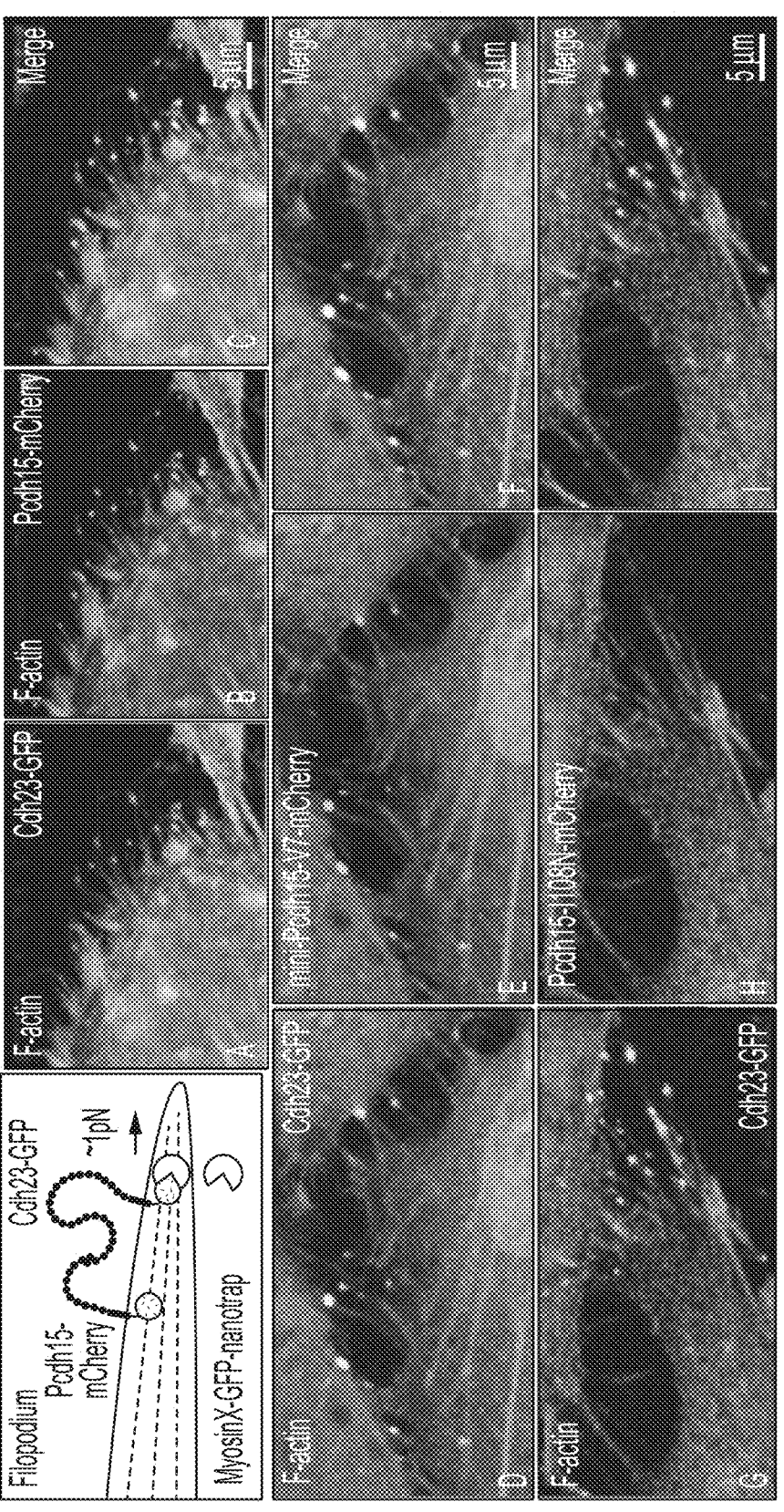
FIG. 4 is an image showing nano-SPD assay for PCDH15 binding to CDH23 under force. Top left shows a schematic of myosin motor and linked cadherins: myosin-X with a GFP-nanotrap binds to GFP, pulling CDH-23-GFP (bait) to the tips of filopodia. If the prey protein (PCDH-15-mCherry) interacts with the bait, both will be trafficked to the tips of filopodia. Positive controls are shown in the top panels. In the middle panel, the images show experimental groups and the results demonstrate that mini-PCDH15 version 7 was properly drawn to the tips by CDH23. The bottom panel show negative control groups, and the results indicate wild-type PCDH15 with an inactivating deafness mutation (I108N) is not drawn to the tips by CDH23. Images from left to right are: GFP-tagged CDH23 was drawn to the tips of filopodia by the myosin; mCherry-tagged control PCDH15 was drawn to the tips by CDH23; and a merged image shows co-localization.

To test whether the miniPcdh15-Cdh23 interaction can withstand a force applied by a myosin motor, the nano-SPD technique was used (Bird J E, Barzik M, Drummond M C, et al. Harnessing molecular motors for nanoscale pulldown in live cells. Mol Biol Cell. 2017; 28(3):463-475. doi: 10.1091/mbc.E16-08-0583). It has been shown that native EGFP-tagged CDH23, when pulled by myosin-X, can transport mCherry-tagged PCDH15 to the tips of fillopodia. As additional controls, these results were further validated using mutant forms of PCDH15 (PCDH15-R113G and PCDH15-I108N) that are known to weaken the PCDH15-CDH23 interaction. The miniPCDH15s were tested for their interaction with CDH23 to withstand force applied by myosin motor. In FIG. 4, Nano-SPD assay for PCDH15 binding to CDH23 under force are shown. Top left shows schematic of myosin motor and linked cadherins: myosin-X with a GFP-nanotrap binds to GFP, pulling CDH-23-GFP (bait) to the tips of filopodia. If the prey protein (PCDH-15-mCherry) interacts with the bait, both will be trafficked to the tips of filopodia. Positive controls are shown in the top panels. In the middle panel, the images show experimental groups and the results demonstrate that mini-PCDH15 version 7 was properly drawn to the tips by CDH23. The bottom panel show negative control groups, and the results indicate wild-type PCDH15 with an inactivating deafness mutation (I108N) is not drawn to the tips by CDH23. Images from left to right are: GFP-tagged CDH23 was drawn to the tips of filopodia by the myosin; mCherry-tagged control PCDH15 was drawn to the tips by CDH23; and a merged image shows co-localization.

To investigate the ability of mini-PCDH15s to rescue hair-cell function, a Pcdh15fl/fl mouse line was created by inserting loxP sites flanking Pcdh15 exon 31 which encodes the single transmembrane domain. The mice are crossed to a Gfi1-Cre line to delete exon 31 in hair cells. Gfi1-Cre expression in cochlear hair cells begins at E15.5 (Yang et al, 2010), likely allowing brief expression of wild-type Pcdh15 in hair cells. A Myo15-Cre mouse (Caberlotto et al., 2011) allowing longer expression of wild-type Pcdh15 before deletion was used. The best mini-PCDH15s are expressed in inner ear hair cells of PCDH15-KO (Pcdh15fl/flxGfi1-Cre) mice. Each mini-PCDH15 coding sequence, driven by a short promoter, are delivered with an AAV9-PHP.B vector. Vectors are injected into inner ears of PCDH15-KO mice at P0; cochlear explants will be cultured at P4 and kept for 1-5 more days before testing.

To test physiological function, FM1-43 dye loading and single-cell electrophysiology is used to assess mechano-transduction in PCDH15-null hair cells. AAV9-PHP.B encoding mini-PCDH15s are injected into inner ears of PCDH15-KO mice at P0. Cochleas are removed at P4, and cultured for 1-3 days before being tested. no dye loading in non-injected PCDH15-KO mice should be observed, after the Cre eliminates endogenous Pcdh15 expression and tip links are lost. After injection, if mini-PCDH15 is functional, dye loading of most hair cells should be observed. For single-cell electrophysiology, receptor currents from individual cells with a patch pipet while stimulating individual hair bundles are recorded with a glass probe. If mini-PCDH15 is functional, the receptor currents will be within the normal receptor currents of 500-800 pA.

To test functional hearing, mini-PCDH15s are expressed using AAV9-PHP.B and are injected at P0. Mice are allowed to survive to adulthood (4 weeks) and hearing with the auditory brainstem evoked response (ABR) will be tested. In normal mice, mid-frequency sounds as quiet at 30 dB evoke an ABR; in KO mice, sounds of 100 dB do not. If mini-PCDH15 constructs are functional, substantial rescue of hearing is expected, with ABRs evoked at 40-50 dB. Auditory function will be retested at 8 weeks to assess long-term rescue. Distortion product otoacoustic emissions (DPOAEs) is measured to specifically assess the functional rescue of outer hair cells, since AAVs are less efficient in transducing outer hair cells.

As in human Usher syndrome, mice lacking functional PCDH15 also have vestibular dysfunction. Virus injected into mouse cochlea diffuses to the vestibular organs and should rescue balance (Gyorgy et al., 2017). To test PCDH15-KO mice, circling behavior is observed, quantified by video recording, and swimming. Normal mice swim with their heads above the surface; mutant mice have no sense of 'up' and tumble underwater. Similarly to the rescue of a different deaf mouse model (Gyorgy et al., 2017), mini-PCDH15 injected mice show no circling and should swim normally.

Pcdh15fl/flxGfi1-Cre mice show disrupted bundle morphology, lack anti-PCDH15 antibody labelling on stereocilia (FIG. 1G), are profoundly deaf, and have a vestibular deficit evidenced by circling behavior. However the bundle morphology deficit in Pcdh15fl/flxGfi1-Cre mice is much less pronounced than in Av3j mice (Alagramam et al., 2011), and hair cells can be loaded with FM1-43 for a few days postnatally, indicating delayed deletion of Pcdh15. AAV injection into neonatal cochlea is routine in the Corey laboratory, and AAV9-PHP.B transduces 50-70% of OHCs and often more.

To translate the mouse studies to human model of Usher 1F, fibroblasts from a human Usher 1F patient carrying the R245X mutation are obtained. These will be further differentiated into 3D inner ear organoids.

Whether mouse mini-PCDH15s can rescue the bundle morphology and the mechanotransduction function in human hair cells are tested using an inner ear organoid system. Bundle morphology is tested with SEM, and mechanotransduction following mini-PCDH15 expression using FM1-43 dye uptake and single-cell physiology. Functional mini-PCDH15 expression should improve bundle morphology, and rescue dye uptake and transduction currents by forming functional tip links. Immunogold SEM will assess localization of exogenous PCDH15 at the tips of stereocilia in organoid hair cells.

Figure 1N:
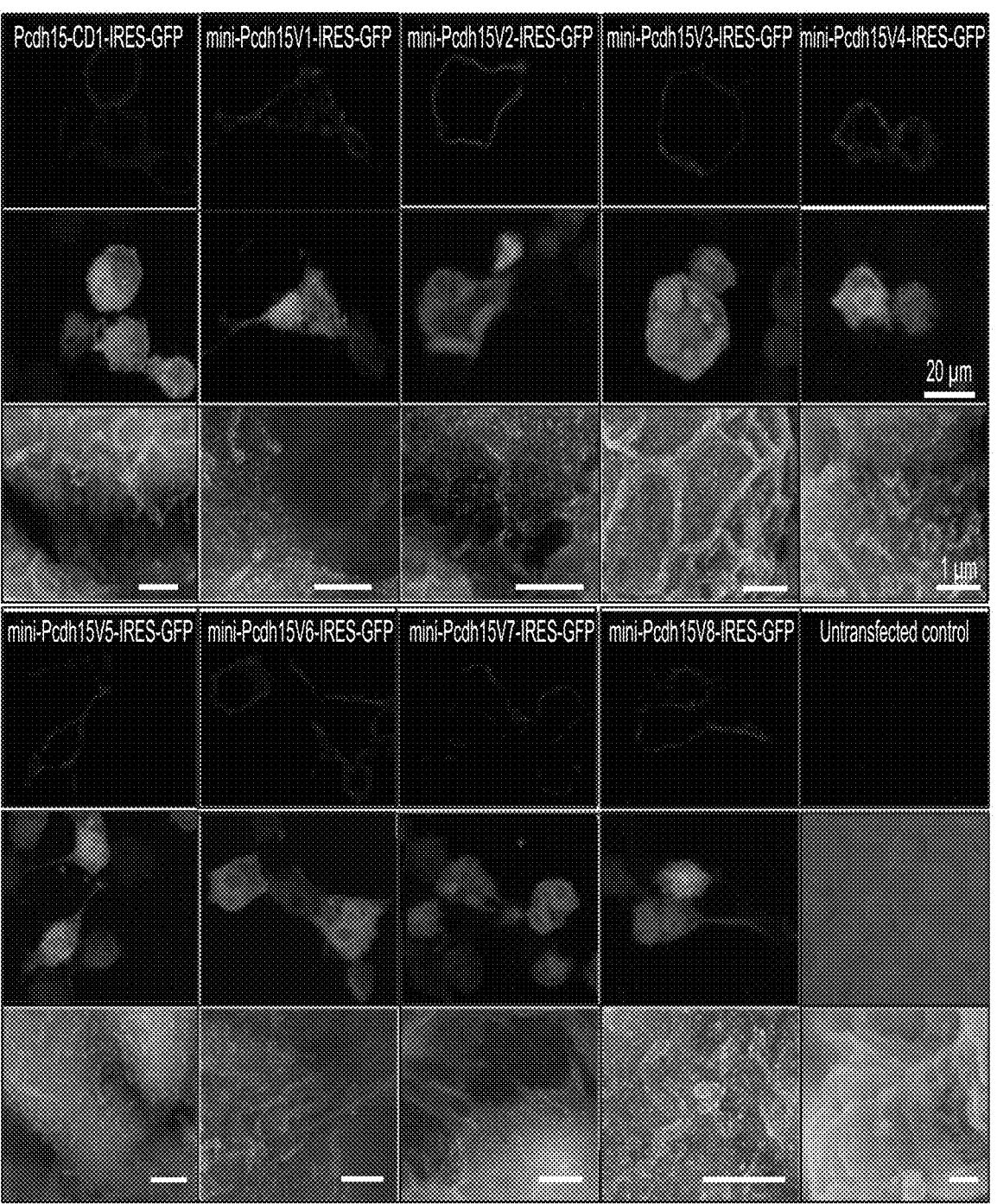

Fluorescence confocal and scanning electron microscopy were used to evaluate hair-cell bundle morphology during bundle development. Stereocilia bundle orientation in cochlear whole mounts were evaluated; actin was stained with phalloidin to visualize stereocilia bundles. In the Pcdh15fl/fl,Gfi1-Cre+ mouse, these showed disrupted bundle morphology in hair cells at P5. Finally, the morphology of inner and outer hair-cell stereocilia bundles were evaluated using scanning electron microscopy (SEM) in P1, P6, and P8 mice. Severe bundle disorganization was detected even at the earliest age evaluated (FIG. 1N). FIG. 1N shows SEM photomicrographs of Pcdh15fl/fl,Gfi1-Cre+ (left) and Pcdh15fl/fl,Gfi1-Cre– (right) OHCs stereocilia bundles at P1 (upper panels) and P5 (lower panels). Hair-cell mechanotransduction was visually assessed by a brief application of FM1-43, known to enter hair cells through functional mechanotransduction channels. FM1-43 loading at P5 by Pcdh15fl/fl,Gfi1-Cre+ hair cells was decreased compared to hair cells in mice without Cre-mediated deletion. The presence of PCDH15 was assessed with immunofluorescent and immunogold anti-Pcdh15 antibody labeling, and confirmed that PCDH15 is completely absent in Pcdh15fl/fl, Gfi1-Cre+ mice at P5.

Next, hearing in Pcdh15fl/fl, Gfi1-Cre+ mice were evaluated. Auditory Brainstem Response (ABR) and Distortion Product Otoacoustic Emission (DPOAE) thresholds in response to pure tone stimuli were measured in these mice. As expected, Pcdh15fl/fl, Gfi1-Cre+ mice were profoundly deaf at P21. All versions of mini-PCDH15 are injected to the mice to evaluate recue of hearing loss in these mice.

Figure 1O:
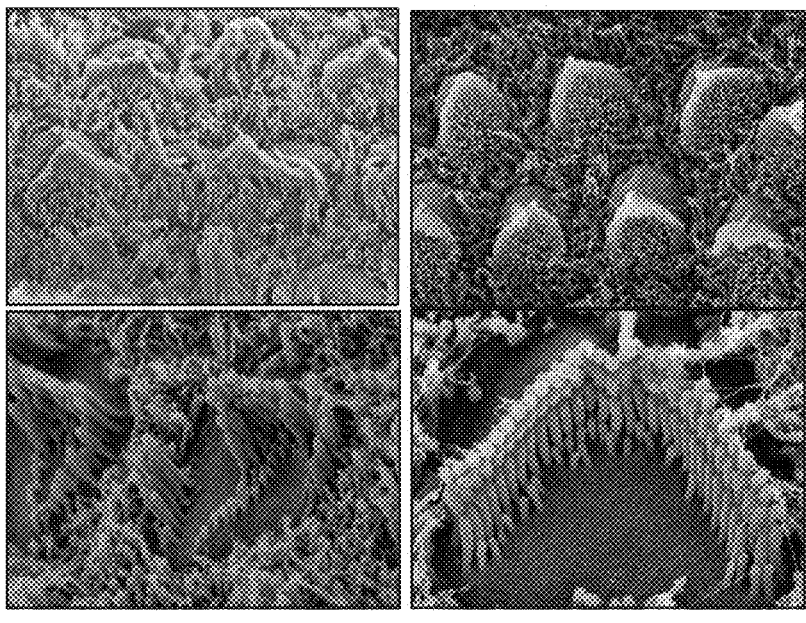
Figure 1P:
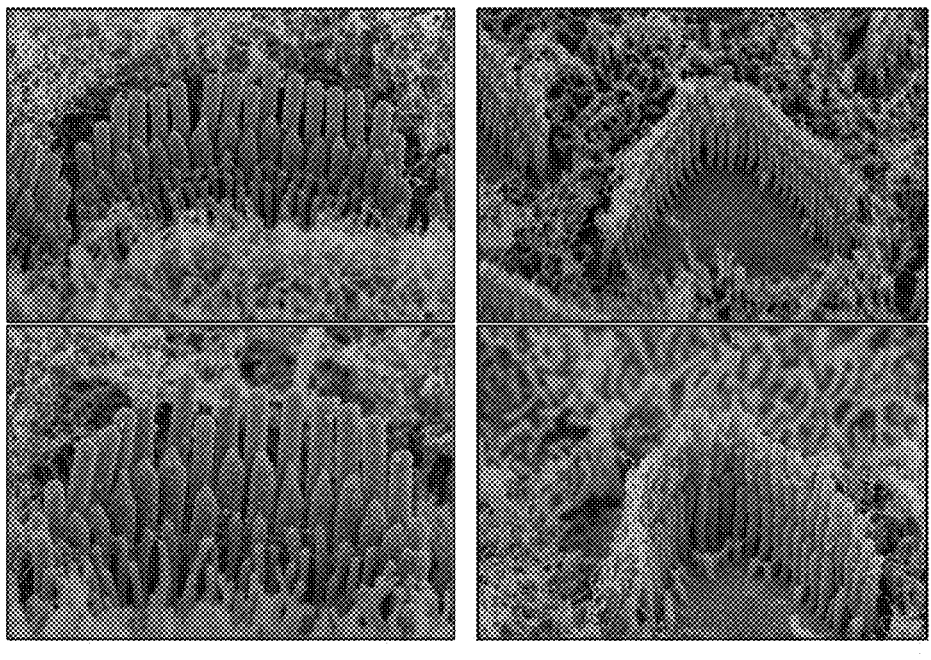

Further, another mouse model, Pcdh15fl/fl,Myo15-Cre+ mice, were developed to model late onset PCDH15 deficit. Because the Pcdh15fl/fl,Gfi1-Cre+mouse has severe bundle pathology at the time of the attempt rescue by viral injection (P1), it was of concern that the observed functional deficit was an indirect effect of the bundle disorganization. Therefore, Pcdh15fl/fl,Myo15-Cre+ mice was created with a late-onset PCDH15 deficit. This mouse is homozygous for a floxed exon that encodes the critical transmembrane domain of PCDH15. It is heterozygous for Myo15-Cre, which drives expression of Cre recombinase under the Myo15 promoter, a late-onset, hair-cell-specific promoter. Stereocilia bundle morphology in cochleas was evaluated in which actin was stained with phalloidin and also used SEM. The data showed normal bundle morphology and presence of tip links in hair cells at P6 (FIG. 1O). FIG. 1O shows SEM photomicrographs of Pcdh15fl/fl,Gfi1-Cre– (upper panel) and Pcdh15fl/fl,Gfi1-Cre+(lower panel) stereocilia bundles at P6. Finally, it was confirmed that Pcdh15fl/fl, Gfi1-Cre+ mice were profoundly deaf at P35 and P60. Thus the pathology observed at P35 and P60 was a consequence of disrupting the mechanotransduction process and not just the bundle disorganization.

Figure 3A:
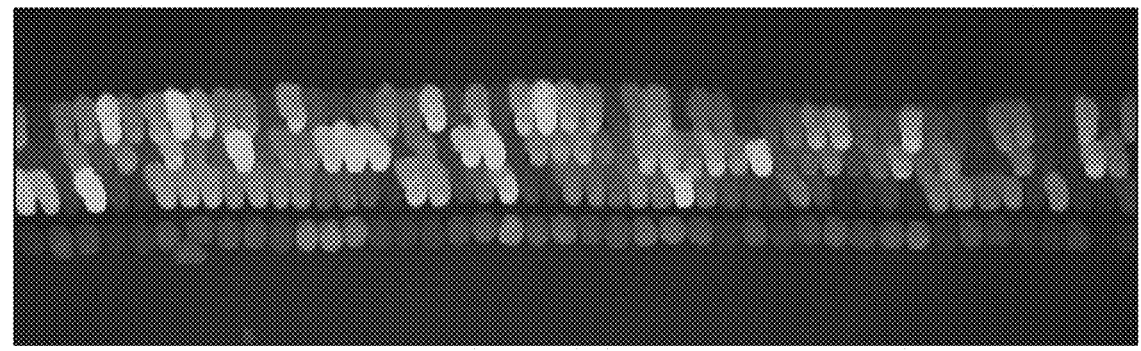
FIGS. 3A-3E are graphs showing ssAAV9-PHP.B-CMV584 bp-miniPCDH15-noWPRE-BGHpolyA in rescuing hearing loss in mice.

In order to test the viral transduction efficiency in delivering transgene to cochlear hair cells, ssAAV9-PHP.B-CMV584 bp-eGFP-noWPRE-BGHpolyA virus were used to infect cochlear hair cells in C57BL/6 mice. Because the hybrid CBA promoter, previously tested in cochlea, is too large to fit into a single AAV vector (~5 kb capacity) even with the shortest mini-PCDH15s (V4, V7, V8), a short CMV promoters was used in the mouse cochlea. An AAV plasmid which has a CMV584 bp promoter with eGFP reporter, no WPRE and BGH polyA was used as a backbone for packaging V4, V7, and V8 mini-PCDH15s. The CMV584 bp-eGFP-noWPRE-BGHpolyA vector was packaged in the AAV9-PHP.B capsid and its efficiency in the cochlea was tested. Robust eGFP expression in both IHCs and OHCs thought the cochlea in C57BL/6 mice at P5 were observed (FIG. 3A).

In addition, three versions of mouse miniPCDH15 AAV vector were constructed and tested for their abilities in preventing hearing loss.

```
An exemplary nucleic acid sequence for
AAV2-CMV584bp-V4-mouse miniPCDH15-
noWPRE-BGHpolyA is set forth in
SEQ ID NO: 116:
TTGGCCACTCCCTCTCTGCGCGCTCGCTCGCTCACTGAGGCCGGG

CGACCAAAGGTCGCCCGACGCCCGGGCTTTGCCCGGGCGGCCTCA

GTGAGCGAGCGAGCGCGCAGAGAGGGAGTGGCCAACTCCATCACT

AGGGGTTCCTAGATCTGAATTCGGTACCGCGGCCGCGACATTGAT

TATTGACTAGTTATTAATAGTAATCAATTACGGGGTCATTAGTTC

ATAGCCCATATATGGAGTTCCGCGTTACATAACTTACGGTAAATG

GCCCGCCTGGCTGACCGCCCAACGACCCCCGCCCATTGACGTCAA

TAATGACGTATGTTCCCATAGTAACGCCAATAGGGACTTTCCATT

GACGTCAATGGGTGGAGTATTTACGGTAAACTGCCCACTTGGCAG

TACATCAAGTGTATCATATGCCAAGTACGCCCCCTATTGACGTCA

ATGACGGTAAATGGCCCGCCTGGCATTATGCCCAGTACATGACCT

TATGGGACTTTCCTACTTGGCAGTACATCTACGTATTAGTCATCG

CTATTACCATGGTGATGCGGTTTTGGCAGTACATCAATGGGCGTG

GATAGCGGTTTGACTCACGGGGATTTCCAAGTCTCCACCCCATTG

ACGTCAATGGGAGTTTGTTTTGGCACCAAAATCAACGGGACTTTC

CAAAATGTCGTAACAACTCCGCCCCATTGACGCAAATGGGCGGTA

GGCGTGTACGGTGGGAGGTCTATATAAGCAGAGCTGCTAGCGTTT

AAACTTAAGCTTGGTACCATGTTCCTACAGTTTGCTGTCTGGAAG

TGTTTACCCCATGGGATCCTCATTGCCTCTCTCTTGGTAGTCAGC

TGGGGCCAGTATGACGATGACTGGCAATACGAGGATTGCAAACTA

GCTAGGGGAGGACCACCAGCTACTATCGTGGCCATTGATGAAGAG

AGTCGAAACGGTACAATTCTGGTGGATAACATGTTGATTAAGGGG

ACTGCCGGAGGACCAGACCCCACCATAGAGCTCTCTTTAAAGGAC

AACGTGGACTACTGGGTGTTGCTGGACCCCGTTAAACAGATGCTT

TTCCTGAACAGTACCGGAAGAGTTCTGGATAGAGACCCACCAATG

AACATACACTCCATTGTGGTGCAAGTCCAGTGTGTCAACAAGAAG

GTTGGCACAGTTATCTATCATGAAGTACGCATCGTGGTGCGAGAT

CGGAATGACAACTCCCCCACATTCAAGCATGAAAGCTACTATGCC
```

-continued

ACCGTGAATGAGCTCACTCCAGTTGGCACCACGATATTCACGGGG

TTCTCGGGAGACAATGGAGCTACAGACATAGACGATGGCCCTAAT

GGACAGATAGAATACGTGATTCAGTACAACCCAGAAGATCCGACA

TCCAACGACACCTTTGAAATTCCACTCATGCTGACTGGCAACGTG

GTACTGAGGAAAAGACTCAACTATGAGGATAAGACTCGCTACTAT

GTCATCATCCAAGCAAATGACCGTGCACAAAATCTGAATGAGAGG

CGAACAACCACCACCACCCTCACAGTAGATGTTCTAGATGGAGAT

GACCTGGGACCTATGTTTCTGCCTTGTGTTCTTGTGCCAAACACA

CGTGACTGTCGTCCACTCACCTACCAAGCTGCCATTCCTGAACTG

AGGACTCCGGAAGAACTGAACCCTATTTTGGTGACACCACCTATC

CAAGCCATTGATCAGGACCGAAACATCCAACCACCATCTGATCGA

CCTGGCATCCTCTACTCCATCCTTGTCGGCACCCCTGAGGATTAC

CCCCGCTTCTTCCATATGCATCCCAGGACTGCAGAACTCACTCTC

CTGGAGCCAGTAAACAGAGACTTCCATCAAAAATTTGATTTGGTT

ATTAAGGCTGAGCAGGACAATGGCCACCCACTTCCTGCCTTTGCT

AGTCTGCACATCGAAATACTAGACGAAAACAATCAGCCTCCAGTG

TTTAGCAAACGCATCTACAAGGGGATGGTGGCTCCAGATGCAGTC

AAGGGGACACCAATCACCACCGTTTATGCTGAAGATGCGGACCCA

CCTGGGATGCCTGCAAGTAGGGTGAGGTATCGAGTGGACGACGTG

CAGTTTCCATACCCAGCCAGTATTTTTGATGTAGAGGAAGATTCT

GGAAGAGTAGTAACCCGCGTCAATCTTAATGAAGAGCCTACTACG

ATTTTCAAGCTGGTGGTTGTGGCTTTTGATGACGGCGAACCTGTG

ATGTCCAGCAGTGCCACGGTGAGAATTCTTGTCTTACATCCTGGA

GAGATCCCACGCTTCACCCAAGAGGAATACAGACCTCCTCCTGTA

AGTGAGCTTGCGGCCAGAGGGACTGTAGTTGGTGTCATTTCTGCT

GCTGCCATTAATCAGAGCATCGTGTACTCCATTGTGGCAGGAAAT

GAGGAAGACAAGTTTGGAATCAACAATGTCACTGGGGTCATCTAT

GTGAATTCACCATTGGATTACGAGACAAGGACCAGCTATGTGCTC

CGGGTACAAGCAGATTCTCTGGAAGTGGTCCTTGCCAATCTCCGA

GTCCCTTCAAAAAGCAATACAGCTAAGGTGTACATTGAGATTCAG

GATGAAAACGATCACCCCCCAGTGTTCCAGAAGAAATTCTACATT

GGAGGTGTGTCTGAAGACGCAAGGATGTTCGCATCTGTGCTCAGA

GTGAAGGCCACCGACAGGGACACGGGTAATTACAGTGCCATGGCC

TACCGGCTCATCATACCGCCGATTAAAGAGGGCAAAGAGGGGTTT

GTGGTGGAAACATACACAGGTCTCATCAAGACAGCCATGCTCTTC

CACAATATGAGAAGATCCTACTTCAAGTTTCAAGTGATTGCAACT

GACGACTACGGGAAGGGGTTGAGCGGGAAAGCAGACGTACTGGTC

TCCGTGGTCAATCAACTGGATATGCAGGTCATTGTCTCCAATGTG

CCCCCTACACTAGTGGAAAAGAAGATAGAAGACCTTACAGAGATT

TTGGATCGCTACGTTCAGGAGCAAATTCCTGGTGCCAAGGTTGTG

GTGGAGTCCATAGGTGCCCGTCGCCATGGAGACGCCTACTCCCTA

-continued

GAAGACTATAGCAAGTGCGACCTGACTGTCTATGCCATCGACCCG

CAGACCAACAGAGCCATCGACAGAAATGAGCTTTTTAAGTTCCTG

GACGGCAAACTGCTCGATATCAATAAAGACTTCCAGCCGTATTAC

GGGGAAGGAGGGCGCATTCTGGAGATTCGGACACCTGAGGCAGTG

ACGAGCATCAAGAAGCGAGGAGAAAGCTTGGGGTACACAGAAGGG

GCCTTGCTGGCCTTGGCCTTCATCATCATCCTCTGTTGCATCCCA

GCCATCTTGGTCGTCTTAGTAAGCTACCGACAGTTTAAAGTACGC

CAGGCTGAGTGCACGAAGACCGCAAGAATTCAGTCTGCTATGCCT

GCAGCCAAGCCTGCAGCTCCTGTACCAGCTGCGCCTGCGCCGCCC

CCGCCCCCGCCACCACCACCACCAGGAGCACATCTCTATGAAGAA

CTGGGAGAGAGCGCAATGCATAAGTATGAGATGCCCCAGTATGGA

AGTCGCCGTCGACTGCTGCCACCTGCTGGACAGGAGGAATACGGC

GAAGTCATTGGTGAAGCTGAAGAGGAATATGAAGAAGAAGAGGTA

GAGCCAGAGAAAGTTAAAAAACCCAAAGTTGAAATTAGAGAGCCT

AGTGAGGAGGAGGTGGTAGTCACCGTTGAGAAGCCACCAGCGGCT

GAGCCCACATACCCAACGTGGAAGAGAGCCAGGATATTCCCGATG

ATTTTTAAGAAAGTCAGAGGTCTCGCTGAGAAAAGAGGCATTGAC

CTTGAGGGCGAGGAGTGGAGGAGGCGCCTTGATGAAGAAGACAAA

GACTATCTTCAACTGACTCTAGACCAGGAGGAAGCTACCGAAAGC

ACCGTGGAGTCAGAGGAGGAGTCCAGCGACTACACAGAATACACA

GAAACGGAGTCCGAGTTCAGCGAGTCCGAGACAACTGAAGAATCA

GAGTCGGAGACCCCATCTGAGGAAGCGGAGGAGAGCTCTACCCCG

GAGTCAGAGGAGTCTGAGTCCACTGAGTCAGAGGGAGAGAAAGCA

AGAAAAAACATCGTGCTGGCTAGAAGAAGGCCTGTGGTCGAGGAA

ATCCAGGAGGTGAAAGGTAAGAGAGAGGAGCCCCCGGTGGAAGAG

GAAGAAGAGCCCCCACTAGAGGAGGAAGAACGGGCAGAGGAAGGA

GAAGAAAGCGAAGCAGCTCCCATGGATGAGTCCACAGACCTGGAG

GCTCAGGATGTCCCAGAGGAGGGCAGTGCAGAATCAGTCTCCATG

GAGAGGGGCGTGGAAAGTGAGGAGTCAGAGTCAGAACTGAGCAGC

AGCAGCAGTACCAGTGAGAGTCTCTCCGGAGGCCCCTGGGGCTTT

CAGGTGCCAGAATATGACAGAAGGAAGGATGAAGAGCCCAAGAAA

TCTCCAGGCGCAAACTCCGAAGGTTACAACACAGCCCTTTAGCTC

GAGTCTAGAGTCGACTAGAGCTCGCTGATCAGCCTCGACTGTGCC

TTCTAGTTGCCAGCCATCTGTTGTTTGCCCCTCCCCCGTGCCTTC

CTTGACCCTGGAAGGTGCCACTCCCACTGTCCTTTCCTAATAAAA

TGAGGAAATTGCATCGCATTGTCTGAGTAGGTGTCATTCTATTCT

GGGGGGTGGGGTGGGCAGGACAGCAAGGGGGAGGATTGGGAAGA

CAATAGCAGGCATGCTGGGGAGAGATCTAGGAACCCCTAGTGATG

-continued

GAGTTGGCCACTCCCTCTCTGCGCGCTCGCTCGCTCACTGAGGCC

GCCCGGGCAAAGCCCGGGCGTCGGGCGACCTTTGGTCGCCCGGCC

TCAGTGAGCGAGCGAGCGCGCAGAGAGGGAGTGGCCA

An exemplary nucleic acid sequence for
AAV2-CMV584bp-V7-mouse miniPCDH15-
noWPRE-BGHpolyA is set forth in
SEQ ID NO: 117:

(SEQ ID NO: 117)
TTGGCCACTCCCTCTCTGCGCGCTCGCTCGCTCACTGAGGCCGGG

CGACCAAAGGTCGCCCGACGCCCGGGCTTTGCCCGGGCGGCCTCA

GTGAGCGAGCGAGCGCGCAGAGAGGGAGTGGCCAACTCCATCACT

AGGGGTTCCTAGATCTGAATTCGGTACCGCGGCCGCGACATTGAT

TATTGACTAGTTATTAATAGTAATCAATTACGGGGTCATTAGTTC

ATAGCCCATATATGGAGTTCCGCGTTACATAACTTACGGTAAATG

GCCCGCCTGGCTGACCGCCCAACGACCCCCGCCCATTGACGTCAA

TAATGACGTATGTTCCCATAGTAACGCCAATAGGGACTTTCCATT

GACGTCAATGGGTGGAGTATTTACGGTAAACTGCCCACTTGGCAG

TACATCAAGTGTATCATATGCCAAGTACGCCCCCTATTGACGTCA

ATGACGGTAAATGGCCCGCCTGGCATTATGCCCAGTACATGACCT

TATGGGACTTTCCTACTTGGCAGTACATCTACGTATTAGTCATCG

CTATTACCATGGTGATGCGGTTTTGGCAGTACATCAATGGGCGTG

GATAGCGGTTTGACTCACGGGGATTTCCAAGTCTCCACCCCATTG

ACGTCAATGGGAGTTTGTTTTGGCACCAAAATCAACGGGACTTTC

CAAAATGTCGTAACAACTCCGCCCCATTGACGCAAATGGGCGGTA

GGCGTGTACGGTGGGAGGTCTATATAAGCAGAGCTGCTAGCGTTT

AAACTTAAGCTTGGTACCATGTTCCTACAGTTTGCTGTCTGGAAG

TGTTTACCCCATGGGATCCTCATTGCCTCTCTCTTGGTAGTCAGC

TGGGGCCAGTATGACGATGACTGGCAATACGAGGATTGCAAACTA

GCTAGGGGAGGACCACCAGCTACTATCGTGGCCATTGATGAAGAG

AGTCGAAACGGTACAATTCTGGTGGATAACATGTTGATTAAGGGG

ACTGCCGGAGGACCAGACCCCACCATAGAGCTCTCTTTAAAGGAC

AACGTGGACTACTGGGTGTTGCTGGACCCCGTTAAACAGATGCTT

TTCCTGAACAGTACCGGAAGAGTTCTGGATAGAGACCCACCAATG

AACATACACTCCATTGTGGTGCAAGTCCAGTGTGTCAACAAGAAG

GTTGGCACAGTTATCTATCATGAAGTACGCATCGTGGTGCGAGAT

CGGAATGACAACTCCCCCACATTCAAGCATGAAAGCTACTATGCC

ACCGTGAATGAGCTCACTCCAGTTGGCACCACGATATTCACGGGG

TTCTCGGGAGACAATGGAGCTACAGACATAGACGATGGCCCTAAT

GGACAGATAGAATACGTGATTCAGTACAACCCAGAAGATCCGACA

TCCAACGACACCTTTGAAATTCCACTCATGCTGACTGGCAACGTG

GTACTGAGGAAAAGACTCAACTATGAGGATAAGACTCGCTACTAT

GTCATCATCCAAGCAAATGACCGTGCACAAAATCTGAATGAGAGG

CGAACAACCACCACCACCCTCACAGTAGATGTTCTAGATGGAGAT

-continued

GACCTGGGACCTATGTTTCTGCCTTGTGTTCTTGTGCCAAACACA

CGTGACTGTCGTCCACTCACCTACCAAGCTGCCATTCCTGAACTG

AGGACTCCGGAAGAACTGAACCCTATTTTGGTGACACCACCTATC

CAAGCCATTGATCAGGACCGAAACATCCAACCACCATCTGATCGA

CCTGGCATCCTCTACTCCATCCTTGTCGGCACCCCTGAGGATTAC

CCCCGCTTCTTCCATATGCATCCCAGGACTGCAGAACTCACTCTC

CTGGAGCCAGTAAACAGAGACTTCCATCAAAAATTTGATTTGGTT

ATTAAGGCTGAGCAGGACAATGGCCACCCACTTCCTGCCTTTGCT

AGTCTGCACATCGAAATACTAGACGAAAACAATCAGGCTCCCGTG

TTCGATCCCTATCTGCCCAGGAACCTCTCTGTGGTGGAGGAAGAA

GCCAATGCCTTTGTGGGTCAAGTCCGGGCAACAGACCCAGATGCT

GGGATAAACGGCCAAGTTCACTACAGCCTGGGGAACTTCAACAAC

CTCTTCCGCATCACATCCAACGGGAGCATTTACACAGCCGTGAAG

CTGAACAGGGAAGCCAGGGACCACTATGAACTGGTTGTCGTGGCA

ACAGATGGAGCAGTCCACCCTCGACATTCAACTCTGACACTGTAC

ATCAAGGTGTTGGACATTGATGATAACAGTCCTGTTTTTACCAAT

TCAACGTACACAGTTGTCGTTGAAGAGAATCTGCCAGCCGGGACC

TCCTTTCTTCAAATAGAGGCCAAGGATGTTGACCTTGGAGCCAAT

GTGTCATATCGGATCAGAAGCCCAGAAGTGAAACACCTTTTTGCA

CTGCATCCATTCACTGGAGAATTGTCTCTTCTGAGGAGTTTGGAT

TATGAGGCCTTTCCGGACCAGGAGGCAAGCATCACATTCTTGGTG

GAGGCCTTTGACATTTATGGGACTATGCCACCTGGTATAGCAACA

GTCACGGTAATTGTGAAGGACATGAATGACTACCCCCCCAGTGTTC

CAGAAGAAATTCTACATTGGAGGTGTGTCTGAAGACGCAAGGATG

TTCGCATCTGTGCTCAGAGTGAAGGCCACCGACAGGGACACGGGT

AATTACAGTGCCATGGCCTACCGGCTCATCATACCGCCGATTAAA

GAGGGCAAAGAGGGGTTTGTGGTGGAAACATACACAGGTCTCATC

AAGACAGCCATGCTCTTCCACAATATGAGAAGATCCTACTTCAAG

TTTCAAGTGATTGCAACTGACGACTACGGGAAGGGGTTGAGCGGG

AAAGCAGACGTACTGGTCTCCGTGGTCAATCAACTGGATATGCAG

GTCATTGTCTCCAATGTGCCCCCTACACTAGTGGAAAAGAAGATA

GAAGACCTTACAGAGATTTTGGATCGCTACGTTCAGGAGCAAATT

CCTGGTGCCAAGGTTGTGGTGGAGTCCATAGGTGCCCGTCGCCAT

GGAGACGCCTACTCCCTAGAAGACTATAGCAAGTGCGACCTGACT

GTCTATGCCATCGACCCGCAGACCAACAGAGCCATCGACAGAAAT

GAGCTTTTTAAGTTCCTGGACGGCAAACTGCTCGATATCAATAAA

GACTTCCAGCCGTATTACGGGGAAGGAGGGCGCATTCTGGAGATT

CGGACACCTGAGGCAGTGACGAGCATCAAGAAGCGAGGAGAAAGC

TTGGGGTACACAGAAGGGGCCTTGCTGGCCTTGGCCTTCATCATC

ATCCTCTGTTGCATCCCAGCCATCTTGGTCGTCTTAGTAAGCTAC

CGACAGTTTAAAGTACGCCAGGCTGAGTGCACGAAGACCGCAAGA

-continued

ATTCAGTCTGCTATGCCTGCAGCCAAGCCTGCAGCTCCTGTACCA

GCTGCGCCTGCGCCGCCCCCGCCCCCGCCACCACCACCACCAGGA

GCACATCTCTATGAAGAACTGGGAGAGAGCGCAATGCATAAGTAT

GAGATGCCCCAGTATGGAAGTCGCCGTCGACTGCTGCCACCTGCT

GGACAGGAGGAATACGGCGAAGTCATTGGTGAAGCTGAAGAGGAA

TATGAAGAAGAAGAGGTAGAGCCAGAGAAAGTTAAAAAACCCAAA

GTTGAAATTAGAGAGCCTAGTGAGGAGGAGGTGGTAGTCACCGTT

GAGAAGCCACCAGCGGCTGAGCCCACATACCCAACGTGGAAGAGA

GCCAGGATATTCCCGATGATTTTTAAGAAAGTCAGAGGTCTCGCT

GAGAAAAGAGGCATTGACCTTGAGGGCGAGGAGTGGAGGAGGCGC

CTTGATGAAGAAGACAAAGACTATCTTCAACTGACTCTAGACCAG

GAGGAAGCTACCGAAAGCACCGTGGAGTCAGAGGAGGAGTCCAGC

GACTACACAGAATACACAGAAACGGAGTCCGAGTTCAGCGAGTCC

GAGACAACTGAAGAATCAGAGTCGGAGACCCATCGAGGAAGCG

GAGGAGAGCTCTACCCCGGAGTCAGAGGAGTCTGAGTCCACTGAG

TCAGAGGGAGAGAAAGCAAGAAAAAAACATCGTGCTGGCTAGAAGA

AGGCCTGTGGTCGAGGAAATCCAGGAGGTGAAAGGTAAGAGAGAG

GAGCCCCCGGTGGAAGAGGAAGAAGAGCCCCCACTAGAGGAGGAA

GAACGGGCAGAGGAAGGAGAAGAAAGCGAAGCAGCTCCCATGGAT

GAGTCCACAGACCTGGAGGCTCAGGATGTCCCAGAGGAGGGCAGT

GCAGAATCAGTCTCCATGGAGAGGGGCGTGGAAAGTGAGGAGTCA

GAGTCAGAACTGAGCAGCAGCAGCAGTACCAGTGAGAGTCTCTCC

GGAGGCCCCTGGGGCTTTCAGGTGCCAGAATATGACAGAAGGAAG

GATGAAGAGCCCAAGAAATCTCCAGGCGCAAACTCCGAAGGTTAC

AACACAGCCCTTTAGCTCGAGTCTAGAGTCGACTAGAGCTCGCTG

ATCAGCCTCGACTGTGCCTTCTAGTTGCCAGCCATCTGTTGTTTG

CCCCTCCCCCGTGCCTTCCTTGACCCTGGAAGGTGCCACTCCCAC

TGTCCTTTCCTAATAAAATGAGGAAATTGCATCGCATTGTCTGAG

TAGGTGTCATTCTATTCTGGGGGGTGGGGTGGGGCAGGACAGCAA

GGGGGAGGATTGGGAAGACAATAGCAGGCATGCTGGGGAGAGATC

TAGGAACCCCTAGTGATGGAGTTGGCCACTCCCTCTCTGCGCGCT

CGCTCGCTCACTGAGGCCGCCCGGGCAAAGCCCGGGCGTCGGGCG

ACCTTTGGTCGCCCGGCCTCAGTGAGCGAGCGAGCGCGCAGAGAG

GGAGTGGCCA

An exemplary nucleic acid sequence for
AAV2-CMV584bp-V8-mouse miniPCDH15-
noWPRE-BGHpolyA is set forth in
SEQ ID NO: 118:
(SEQ ID NO: 118)
TTGGCCACTCCCTCTCTGCGCGCTCGCTCGCTCACTGAGGCCGGG

CGACCAAAGGTCGCCCGACGCCCGGGCTTTGCCCGGGCGGCCTCA

GTGAGCGAGCGAGCGCGCAGAGAGGGAGTGGCCAACTCCATCACT

AGGGGGTTCCTAGATCTGAATTCGGTACCGCGGCCGCGACATTGAT

-continued

TATTGACTAGTTATTAATAGTAATCAATTACGGGGTCATTAGTTC

ATAGCCCATATATGGAGTTCCGCGTTACATAACTTACGGTAAATG

GCCCGCCTGGCTGACCGCCCAACGACCCCCGCCCATTGACGTCAA

TAATGACGTATGTTCCCATAGTAACGCCAATAGGGACTTTCCATT

GACGTCAATGGGTGGAGTATTTACGGTAAACTGCCCACTTGGCAG

TACATCAAGTGTATCATATGCCAAGTACGCCCCCTATTGACGTCA

ATGACGGTAAATGGCCCGCCTGGCATTATGCCCAGTACATGACCT

TATGGGACTTTCCTACTTGGCAGTACATCTACGTATTAGTCATCG

CTATTACCATGGTGATGCGGTTTTGGCAGTACATCAATGGGCGTG

GATAGCGGTTTGACTCACGGGGATTTCCAAGTCTCCACCCCATTG

ACGTCAATGGGAGTTTGTTTTGGCACCAAAATCAACGGGACTTTC

CAAAATGTCGTAACAACTCCGCCCCATTGACGCAAATGGGCGGTA

GGCGTGTACGGTGGGAGGTCTATATAAGCAGAGCTGCTAGCGTTT

AAACTTAAGCTTGGTACCATGTTCCTACAGTTTGCTGTCTGGAAG

TGTTTACCCCATGGGATCCTCATTGCCTCTCTCTTGGTAGTCAGC

TGGGGCCAGTATGACGATGACTGGCAATACGAGGATTGCAAACTA

GCTAGGGGAGGACCACCAGCTACTATCGTGGCCATTGATGAAGAG

AGTCGAAACGGTACAATTCTGGTGGATAACATGTTGATTAAGGGG

ACTGCCGGAGGACCAGACCCCACCATAGAGCTCTCTTTAAAGGAC

AACGTGGACTACTGGGTGTTGCTGGACCCCGTTAAACAGATGCTT

TTCCTGAACAGTACCGGAAGAGTTCTGGATAGAGACCCACCAATG

AACATACACTCCATTGTGGTGCAAGTCCAGTGTGTCAACAAGAAG

GTTGGCACAGTTATCTATCATGAAGTACGCATCGTGGTGCGAGAT

CGGAATGACAACTCCCCCACATTCAAGCATGAAAGCTACTATGCC

ACCGTGAATGAGCTCACTCCAGTTGGCACCACGATATTCACGGGG

TTCTCGGGAGACAATGGAGCTACAGACATAGACGATGGCCCTAAT

GGACAGATAGAATACGTGATTCAGTACAACCCAGAAGATCCGACA

TCCAACGACACCTTTGAAATTCCACTCATGCTGACTGGCAACGTG

GTACTGAGGAAAAGACTCAACTATGAGGATAAGACTCGCTACTAT

GTCATCATCCAAGCAAATGACCGTGCACAAAATCTGAATGAGAGG

CGAACAACCACCACCACCCTCACAGTAGATGTTCTAGATGGAGAT

GACCTGGGACCTATGTTTCTGCCTTGTGTTCTTGTGCCAAACACA

CGTGACTGTCGTCCACTCACCTACCAAGCTGCCATTCCTGAACTG

AGGACTCCGGAAGAACTGAACCCTATTTTGGTGACACCACCTATC

CAAGCCATTGATCAGGACCGAAACATCCAACCACCATCTGATCGA

CCTGGCATCCTCTACTCCATCCTTGTCGGCACCCCTGAGGATTAC

CCCCGCTTCTTCCATATGCATCCCAGGACTGCAGAACTCACTCTC

CTGGAGCCAGTAAACAGAGACTTCCATCAAAAATTTGATTTGGTT

ATTAAGGCTGAGCAGGACAATGGCCACCCACTTCCTGCCTTTGCT

AGTCTGCACATCGAAATACTAGACGAAAACAATCAGAGTCCATAC

-continued

TTCACAATGCCCAGCTATCAAGGATACATCCTGGAATCCGCCCCA

GTGGGAGCCACCATTTCTGAGAGCCTAAACTTAACCACTCCTCTG

AGAATTGTAGCTCTGGACAAAGACATAGAAGACACAAAAGATCCA

GAGCTCCACCTCTTCCTGAATGACTACACCTCGGTCTTCACTGTG

ACACCCACTGGTATCACCCGCTACCTCACCCTGCTTCAACCTGTG

GACAGGGAGGAACAGCAAACCTACACCTTTCTGATAACAGCGTTT

GATGGCGTGCAAGAAAGTGAGCCAGTCGTGGTCAATATCCGAGTG

ATGGATGCAAATGATAACGCTCCCGTGTTCGATCCCTATCTGCCC

AGGAACCTCTCTGTGGTGGAGGAAGAAGCCAATGCCTTTGTGGGT

CAAGTCCGGGCAACAGACCCAGATGCTGGGATAAACGGCCAAGTT

CACTACAGCCTGGGGAACTTCAACAACCTCTTCCGCATCACATCC

AACGGGAGCATTTACACAGCCGTGAAGCTGAACAGGGAAGCCAGG

GACCACTATGAACTGGTTGTCGTGGCAACAGATGGAGCAGTCCAC

CCTCGACATTCAACTCTGACACTGTACATCAAGGTGTTGGACATT

GATGATAACCCCCCAGTGTTCCAGAAGAAATTCTACATTGGAGGT

GTGTCTGAAGACGCAAGGATGTTCGCATCTGTGCTCAGAGTGAAG

GCCACCGACAGGGACACGGGTAATTACAGTGCCATGGCCTACCGG

CTCATCATACCGCCGATTAAAGAGGGCAAAGAGGGGTTTGTGGTG

GAAACATACACAGGTCTCATCAAGACAGCCATGCTCTTCCACAAT

ATGAGAAGATCCTACTTCAAGTTTCAAGTGATTGCAACTGACGAC

TACGGGAAGGGGTTGAGCGGGAAAGCAGACGTACTGGTCTCCGTG

GTCAATCAACTGGATATGCAGGTCATTGTCTCCAATGTGCCCCCT

ACACTAGTGGAAAAGAAGATAGAAGACCTTACAGAGATTTTGGAT

CGCTACGTTCAGGAGCAAATTCCTGGTGCCAAGGTTGTGGTGGAG

TCCATAGGTGCCCGTCGCCATGGAGACGCCTACTCCCTAGAAGAC

TATAGCAAGTGCGACCTGACTGTCTATGCCATCGACCCGCAGACC

AACAGAGCCATCGACAGAAATGAGCTTTTTAAGTTCCTGGACGGC

AAACTGCTCGATATCAATAAAGACTTCCAGCCGTATTACGGGGAA

GGAGGGCGCATTCTGGAGATTCGGACACCTGAGGCAGTGACGAGC

ATCAAGAAGCGAGGAGAAAGCTTGGGGTACACAGAAGGGGCCTTG

CTGGCCTTGGCCTTCATCATCATCCTCTGTTGCATCCCAGCCATC

TTGGTCGTCTTAGTAAGCTACCGACAGTTTAAAGTACGCCAGGCT

GAGTGCACGAAGACCGCAAGAATTCAGTCTGCTATGCCTGCAGCC

AAGCCTGCAGCTCCTGTACCAGCTGCGCCTGCGCCGCCCCCGCCC

CCGCCACCACCACCACCAGGAGCACATCTCTATGAAGAACTGGGA

GAGAGCGCAATGCATAAGTATGAGATGCCCCAGTATGGAAGTCGC

CGTCGACTGCTGCCACCTGCTGGACAGGAGGAATACGGCGAAGTC

ATTGGTGAAGCTGAAGAGGAATATGAAGAAGAAGAGGTAGAGCCA

GAGAAAGTTAAAAAACCCAAAGTTGAAATTAGAGAGCCTAGTGAG

GAGGAGGTGGTAGTCACCGTTGAGAAGCCACCAGCGGCTGAGCCC

ACATACCCAACGTGGAAGAGAGCCAGGATATTCCCGATGATTTTT

-continued

AAGAAAGTCAGAGGTCTCGCTGAGAAAAGAGGCATTGACCTTGAG

GGCGAGGAGTGGAGGAGGCGCCTTGATGAAGAAGACAAAGACTAT

CTTCAACTGACTCTAGACCAGGAGGAAGCTACCGAAAGCACCGTG

GAGTCAGAGGAGGAGTCCAGCGACTACACAGAATACACAGAAACG

GAGTCCGAGTTCAGCGAGTCCGAGACAACTGAAGAATCAGAGTCG

GAGACCCCATCTGAGGAAGCGGAGGAGAGCTCTACCCCGGAGTCA

GAGGAGTCTGAGTCCACTGAGTCAGAGGGAGAGAAAGCAAGAAAA

AACATCGTGCTGGCTAGAAGAAGGCCTGTGGTCGAGGGAAATCCAG

GAGGTGAAAGGTAAGAGAGAGGAGCCCCCGGTGGAAGAGGAAGAA

GAGCCCCCACTAGAGGAGGAAGAACGGGCAGAGGAAGGAGAAGAA

AGCGAAGCAGCTCCCATGGATGAGTCCACAGACCTGGAGGCTCAG

GATGTCCCAGAGGAGGGCAGTGCAGAATCAGTCTCCATGGAGAGG

GGCGTGGAAAGTGAGGAGTCAGAGTCAGAACTGAGCAGCAGC

AGTACCAGTGAGAGTCTCTCCGGAGGCCCCTGGGGCTTTCAGGTG

CCAGAATATGACAGAAGGAAGGATGAAGAGCCCAAGAAATCTCCA

GGCGCAAACTCCGAAGGTTACAACACAGCCCTTTAGCTCGAGTCT

AGAGTCGACTAGAGCTCGCTGATCAGCCTCGACTGTGCCTTCTAG

TTGCCAGCCATCTGTTGTTTGCCCCTCCCCCGTGCCTTCCTTGAC

CCTGGAAGGTGCCACTCCCACTGTCCTTTCCTAATAAAATGAGGA

AATTGCATCGCATTGTCTGAGTAGGTGTCATTCTATTCTGGGGGG

TGGGGTGGGGCAGGACAGCAAGGGGGAGGATTGGGAAGACAATAG

CAGGCATGCTGGGGAGAGATCTAGGAACCCCTAGTGATGGAGTTG

GCCACTCCCTCTCTGCGCGCTCGCTCGCTCACTGAGGCCGCCCGG

GCAAAGCCCGGGCGTCGGGCGACCTTTGGTCGCCCGGCCTCAGTG

AGCGAGCGAGCGCGCAGAGAGGGAGTGGCCA

Pcdh15fl/fl,Myo15-Cre+ mice were used to test rescue of hearing with miniPCDH15 versions. Auditory brainstem evoked response (ABR), an electrical signal recorded from the back of the head which is generated by the neurons carrying auditory information to the brain was tested; ABR is a standard measure of cochlear function. Mice lacking the Myo15-Cre and therefore expressing normal PCDH15 respond to sounds of intensity as low as 30 dB. The sensitivity expressed as the lowest intensity that can elicit an ABR signal is plotted against the frequency of the stimulus; normal mice can hear sounds as quiet as 30 dB in middle frequencies from 8 to 16 kHz. Mice with the Myo15-Cre and therefore deleting PCDH15 have little or no response, usually not responding to the loudest tested sound of 85 dB at any frequency.

Figure 3B:
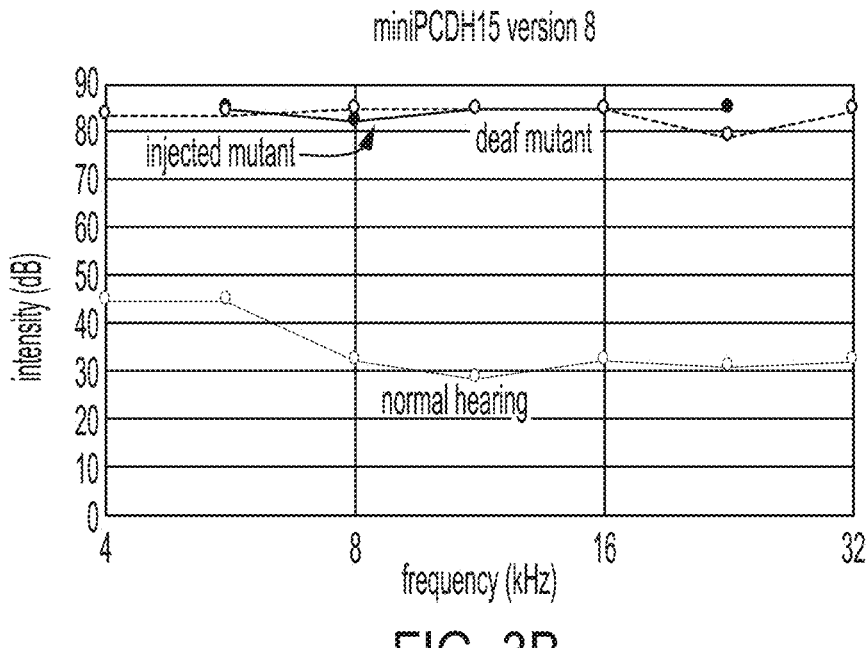
Figure 3C:
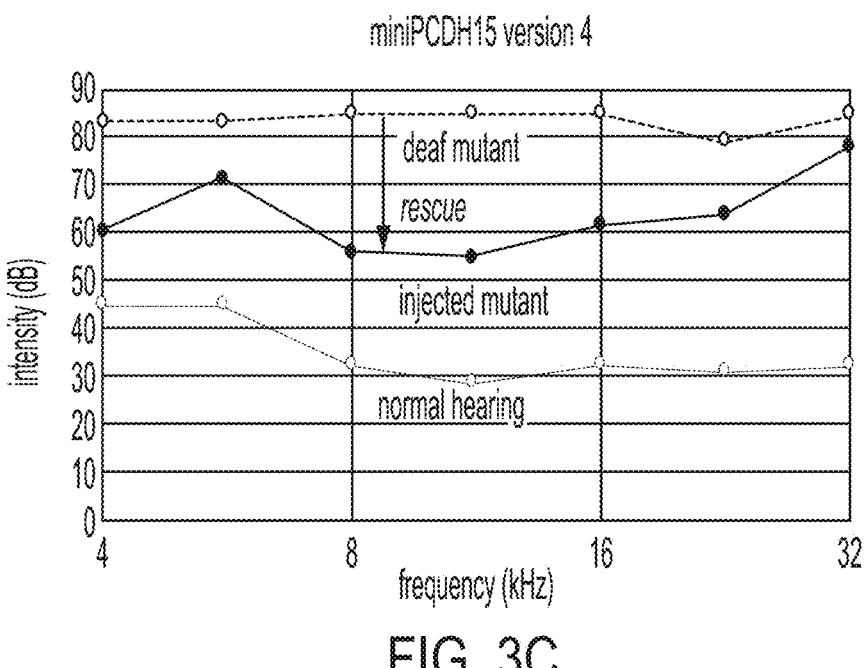
Figure 3D:
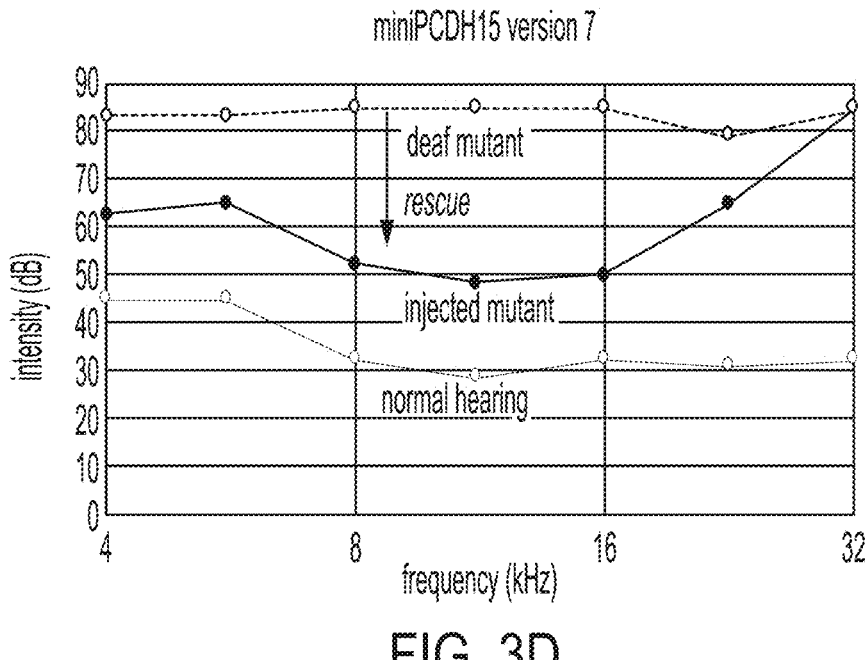
Figure 3E:
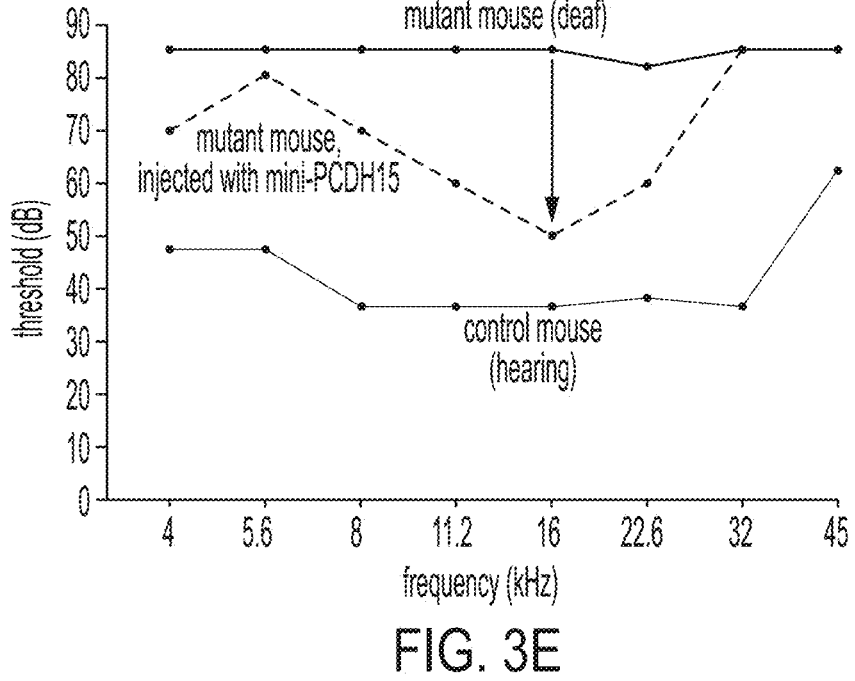

Three miniPCDH15 constructs as described above were tested. rAAV having AAV9-PHP.B capsid encapsulating AAV genome encoding the miniPCDH15 was injected into the cochleas of new born mice (postnatal day 1) that had the Myo15-Cre and would normally lack hearing. Three weeks later, hearing was tested with ABR. miniPCDH15-version 8 (V8) showed no rescue of hearing: at most frequencies there was no response at 85 dB, the same as the untreated deaf mutant (FIG. 3B). A second miniPCDH15, version 4 (V4), showed good rescue, with thresholds in the middle frequencies of ~55 dB, the level of a normal conversation (FIG. 3C). The third miniPCDH15, version 7 (V7), showed the best rescue, lowering thresholds to below 50 dB, only about 20 dB less sensitive than normal hearing. In human, 20-40 dB loss of sensitivity is considered mild hearing loss (FIG. 3D and FIG. 3E). Non-human primate can also be modeled for efficacy of AAV9.PHP.B-mini-PCDH15. Previous data shows AV9-PHP.B encoding GFP shows very strong label throughout the organ of *Corti*, and in most other cells of the cochlear duct. In a wild-type NHP, localization and toxicity can be tested. Using the best mini-PCDH15s constructs from mouse and organoid experiments, primate mini-PCDH15s are designed. An epitope tag is inserted at an exposed non-conserved loop of the extracellular MAD12 domain (P1285, N1323 or G1353), or the N-terminus. The tag can be either 3×HA, SNAP-tag or the high affinity tandem GCN tag (Zhao et al., 2016). Function of the tagged protein is validated in mouse cochlea as in Aim 1b. An AAV9-PHP.B with the mini-PCDH15 coding sequence is constructed, and is injected through the round window membrane in *Macaca fascicularis* monkeys (György et al., 2018). After one month, animals are sacrificed and expression of tagged mini-PCDH15 assessed with an antibody to the tag. Robust expression in hair cells, and label near the tips of the shorter stereocilia should be observed. Toxicity is assessed by testing auditory sensitivity with ABR before viral injection and again before sacrifice. Sections of inner ear is also assessed for inflammation and cell death. RNA Scope technique with mini-PCDH15-specific probes is also used to detect mRNA in the inner ear tissue.

Materials and Methods

Animals: mice were matched for experimental animals to littermate controls. Mice are back-crossed to a common background for at least 8 generations. Mouse strains that lack the Cdh23 Ahl mutation that causes age-related hearing loss, and test new mice, regardless of background, for that mutation were used. Experimental groups are age- and gender-matched.

Histological: Specificity of antibodies is documented in the Authentication of Key Biological Resources. For counting labeled cells, standard protocols for thresholding positive cells were used.

Physiological: To ensure reproducibility for ABR recordings, standard protocols for placement of acoustic systems and ABR electrodes were derived. For measurement of receptor current, the peak current observed in the first three minutes were detected with a standard, automated stimulus protocol.

Behavioral: Video analysis of movement for assessing vestibular function is computer-analyzed. Assessment of swimming ability is scored by an observer but in a strict, second-by-second scoring of mouse position. In both cases, the behavioral tester to experimental group are blinded.

Biolayer Interferometry

A C-terminal SNAP-tag and His tag onto the extracellular domain of PCDH15 is cloned, then immobilize purified SNAP-tagged PCDH15 onto a streptavidin-functionalized probe in an Octet Red 384 by reacting the SNAP-tag with a benzylguanine-biotin ligand. Then, His-tagged CDH23 extracellular domain, constructed as a parallel dimer by fusion with human Fc domains, are affinity purified and analyzed by SDS-PAGE, and the protein identity confirmed by mass spectroscopy. PCDH15 and CDH23 on- and off-rates are analyzed to assess the binding affinity. For each, Ca2+ sensitivity are tested.

Force Spectroscopy

An N-terminal SpyTag into the C-terminal SNAP-tagged PCDH15 construct was cloned for biolayer interferometry. A double stranded DNA handle is created by PCR using a forward primer with a 5' benzylguanine and a reverse primer with a 3' dual biotin. Protein will be reacted with the DNA handle via a SNAP-tag to benzylguanine reaction and purified by His-tag purification. The protein-DNA hybrid is immobilized onto streptavidin-functionalized microspheres. Another DNA handle containing a 5' cysteine-labeled SpyCatcher protein immobilized via a thiol-maleimide reaction and a 3' dual biotin is be coated onto separate streptavidin microspheres. Each microsphere is held in a dual-beam optical tweezer, a single and continuous DNA tether formed by a SpyTag-SpyCatcher reaction, and the tether pulled apart to stretch the PCDH15 molecule. Using high speed video tracking, the unfolding force of WT- and mini-PCDH15 molecules is measured under a constant force loading rate. Unfolding force is tested in 30 µM and 2 mM [Ca2+].

EM of Inner Ear Organoid Systems.

Organoids are cut out with small amounts of surrounding matrigel, fixed with 2.5% glutaraldehyde and further processed using our SEM sample preparation routine (Indzhykulian et al., 2013; Vogl et al, 2016). After critical point drying, the organoids are mounted on an SEM holder and gently cracked open with a needle to expose the inner lumen and expose the bundles. For TEM and FIB-SEM, the organoids are embedded in a resin using our TEM sample preparation routine (Scheffer et al., 2015).

Mouse RWM Injection in Neonatal Mice

P0-P1 CD1 and C57BL/6 pups were anesthetized by hypothermia and then kept on an ice pack during the procedure. As previously described, a small incision was made underneath the external ear. The incision was enlarged, and soft tissues were pushed apart using an eyelid retractor to expose the bulla. Then the round window niche was localized visually. Covering connective tissue was removed to expose the round window.

Adult Mouse Injection 4-week-old mice were anesthetized with ketamine (100 mg/kg) and xylazine (20 mg/kg) through an intraperitoneal injection. Both eyes were protected by an application of eye gel (GenTeal lubricant eye gel). The fur behind the left ear was shaved with a sterile razor, and the surgical area was cleansed two times with antiseptic solution, isolated with sterile drapes, and swabbed along the proposed incision with 10% povidone-iodine. a surgical procedure similar to that described by Suzuki et al. 18 A small (10- to 15-mm) postauricular skin incision was made. After exposing the facial nerve and the sternocleidomastoid muscle by blunt dissection, the tissue covering the temporal was separated and retracted using the magnetic retractor set. A small hole was made with a microprobe in the exposed bony wall of the posterior canal. After 2-3 min for leakage of perilymph to stop, the tip of a MicroFil 35G needle was inserted into the hole. The aperture between the MicroFil needle and the hole was sealed with tissue fragments and cyanoacrylate glue (3 M Vetbond Tissue Adhesive) and visually assessed for lack of fluid leakage. 1 mL viral suspension at 155 nL/min was injected using the Nanoliter 2000 Injector (World Precision Instruments). After the injection was completed, the plastic needle remained in the canal for 5 min and then was cut off proximally to the canal. The hole was filled in with tissue and sealed with glue. The wound was closed with 5-0 Vicryl-coated sutures and swabbed with 10% povidone-iodine. The mouse was placed on a heating pad until full recovery. Animals received an intraperitoneal injection of meloxicam (0.01 mL/g body weight) after surgery and once more within the first 24 hr. Injected mice were checked daily for 5 days following surgery.

Mouse ABR

The ABR assay was performed using a Tucker Davis Technologies System III workstation. Mice were anesthetized by intraperitoneal injection of a ketamine (100 mg/kg)/xylazine (10 mg/kg) cocktail. Anesthetized mice were then placed on a heating pad, and electrodes were placed subcutaneously in the vertex, underneath the left or right ear, and on the back near the tail. Tone stimuli of 4, 5.6, 8, 11.2, 16, 22, 32, and 45.3 kHz were calibrated with a precision microphone system (PS9200 Kit; ACO Pacific), using the TDT SigCal software package. The recorded signals were band-pass filtered (300 Hz to 3 kHz) and amplified 100,000 times. The number of acquisition trials was set to 500 averages. Maximum stimulus intensity was set to 95 dB peak SPL with attenuation decreasing from 85 dB to 0 dB SPL at 5-dB intervals. Band-pass filters (500-3,000 Hz) were applied to the traces before analysis.

Mouse Retina

Animals were handled in accordance with the statement of the "Animals in Research Committee" of the Association for Research in Vision and Ophthalmology (Rockville, MD, USA), and protocols were approved by the local institutional committee (Service vétérinaire du canton de Vaud, Lausanne, Switzerland). Adult C57BL/6 mice were anesthetized with a reversible anesthetic regimen composed of ketamine and medetomidine (ketamine, 30-60 mg/kg, Parker Davis; medetomidine, 0.5-1 mg/kg, Graeub), and the anesthesia was reversed with the injection of atipamezole (0.5-1 mg/kg, Graeub). For subretinal injections, a transscleral approach was used, and the procedure was visualized in the posterior chamber with a microscope and a coverslip covering the cornea surrounded with Viscotears (Novartis, Basel, Switzerland). AAV9-PHP.B-CBA-GFP vector (1 mL) was injected into the sub-retinal space of adult mice through a Hamilton syringe with a 34G needle (BGB Analytik).

Scanning Electron Microscopy

Organ of *Corti* explants were dissected at P1 and P5 in L-15 medium and fixed with 2.5% glutaraldehyde in 0.1 M cacodylate buffer (pH 7.2) supplemented with 2 mM $CaCl_2$) for 1-2 hr at room temperature. For older (P30) animals, after intracardial perfusion with 4% paraformaldehyde and 1% glutaraldehyde, temporal bones were decalcificated overnight in 10% EDTA (pH 7.2-7.4) for 3-4 days at 4° C. After unpeeling cochlear bone and removing the stria vascularis and tectorial membrane, the cochlear coils were isolated; divided into apical, middle, and basal turns; and postfixed with 2.5% glutaraldehyde in 0.1 M cacodylate buffer (pH 7.2) supplemented with 2 mM $CaCl_2$) for 1-2 hr at room temperature. They were rinsed three times in 0.1 M cacodylate buffer (pH 7.2), washed in distilled water, dehydrated in an ascending series of ethanol concentrations, and critical point dried from liquid C02. Samples were then mounted on aluminum stubs with carbon conductive tabs and sputter-coated with 5 nm platinum, and then imaged in a field-emission scanning electron microscope (Hitachi S-4700).

NHP Cochlea

NHP studies were performed at Charles River Laboratories (Montreal, ON, Canada) according to animal use guidelines and approved procedures. The first cynomolgus monkey (*Macaca fascicularis*) (animal #1002) was a male, age 2.6 years, weighing 4 kg. The second animal (animal #3501) was a female, age 3.1 years, weighing 3.2 kg. The animals were anesthetized by intramuscular injection of a cocktail (ketamine, 10 mg/kg; xylazine, 0.6 mg/kg; and glycopyrrolate, 0.01 mg/kg) following overnight food deprivation, intubated, and maintained with oxygen and isoflurane during surgery. During the procedure, the following were administered to improve recovery: warmed lactated Ringer's solution intravenously (10 ml/kg/hr), cefazolin (20 mg/kg every 20-90 min), and topical antibiotics to the surgical site. The RWM was exposed using a trans-mastoid approach. Beginning with a low microscopic magnification, the temporal muscles were retracted exposing the supramastoid crest and the external cartilaginous portion of the ear canal. En route to the middle ear and with increasing magnification, mastoid air cells were burred very closely to the cartilaginous portion of the ear canal, and the bony portion thinned until the *Fossa incudis* was reached, exposing the incus. A 1- to 2-mm facial recess was then performed with awareness of the horizontal semicircular canal, the facial nerve, and the tympanic membrane. The chorda tympani was retracted and/or resected, since it was not possible to preserve it without damaging the critical surrounding structures while allowing necessary exposure of the round window niche. In this species, the RWM is 0.6 mm in diameter.

Statistics

All experiments are designed to identify the most appropriate statistical analysis methods, to plan randomization and blinding, and to calculate sample sizes that provide high statistical reliability while minimizing the number of animals. Additional design tools, such as The Experimental Design Assistant from NC3Rs, are used to plan the experiment and analysis workflow for statistical reliability. To minimize bias, observers during analysis of any outcome measure that is not computer driven are blinded, e.g. ABR thresholds and cell counts. Mice and non-human primates of both sexes, are randomly selected. The sex of Usher 1F patients contributing fibroblasts are random. Prism software was used. p values <0.05 were considered statistically significant.

Example 2: Engineering of Mini-PCDH15 Linker Sequence Between EC Domains

In a full-length PCDH15 protein, the last five amino acids of an EC domain immediately preceding the next EC domain is the linking region between the two EC domains (linkers). Depending on the amino acid sequences of these linkers, they can be flexible or rigid. Some linkers may have different calcium ion binding capacities (e.g., from 0 to 3 $Ca^{2+}$). The presence, absence, or quantity of the $Ca^{2+}$ may be important for proper function of the PCDH15. Linkers between the EC domains of PCDH15 have been previously described (e.g., Sotomayor et al, A partial calcium-free linker confers flexibility to inner-ear protocadherin-15, Structure. 2017 Mar. 7; 25(3): 482-495.) Due to the deletion of certain EC domains in mini-PCDH15, some EC domains are connected artificially, and the succeeding EC domain is connected to the preceding one with a linker different from a full-length PCDH15. For example, in mini-PCDH15 V1, EC3 is connected with EC5, and the linker sequence is the last five amino acids of EC3 (DENNQ), as opposed to the situation in a full-length PCDH15, where EC5 is connected to EC4 with the last five amino acids of EC4 (DANDN).

When connecting two EC domains that are not connected in a full-length PCDH15 (e.g., EC3 connected to EC5 in mini-PCDH15 V1 and V5, EC4 connected to EC8 in mini-PCDH15 V2, EC3 connected to EC8 in mini-PCDH15 V3, EC7 connected to EC11 in mini-PCDH15 V5 and V8, EC4 connected to EC7 in mini-PCDH15 V6 and V8, EC8 connected to EC11 in mini-PCDH15 V6 and V7, EC3 connected to EC9 in mini-PCDH15 V4, EC3 connected to EC7 in mini-PCDH15 V7, EC3 connected to EC11 in mini-PCDH15 V9, and EC2 connected to EC11 in mini-PCDH15 V10), the linking region may or may not affect the function of the miniPCDH15. One skilled in the art would understand that any of the EC domains of PCDH15 may be artificially connected to another EC domain in engineering of the mini-PCDH15. Non-limiting examples of linkers between the EC domains artificially connected in the mini-PCDH15 are shown in the Table 2.

Figure 5A:
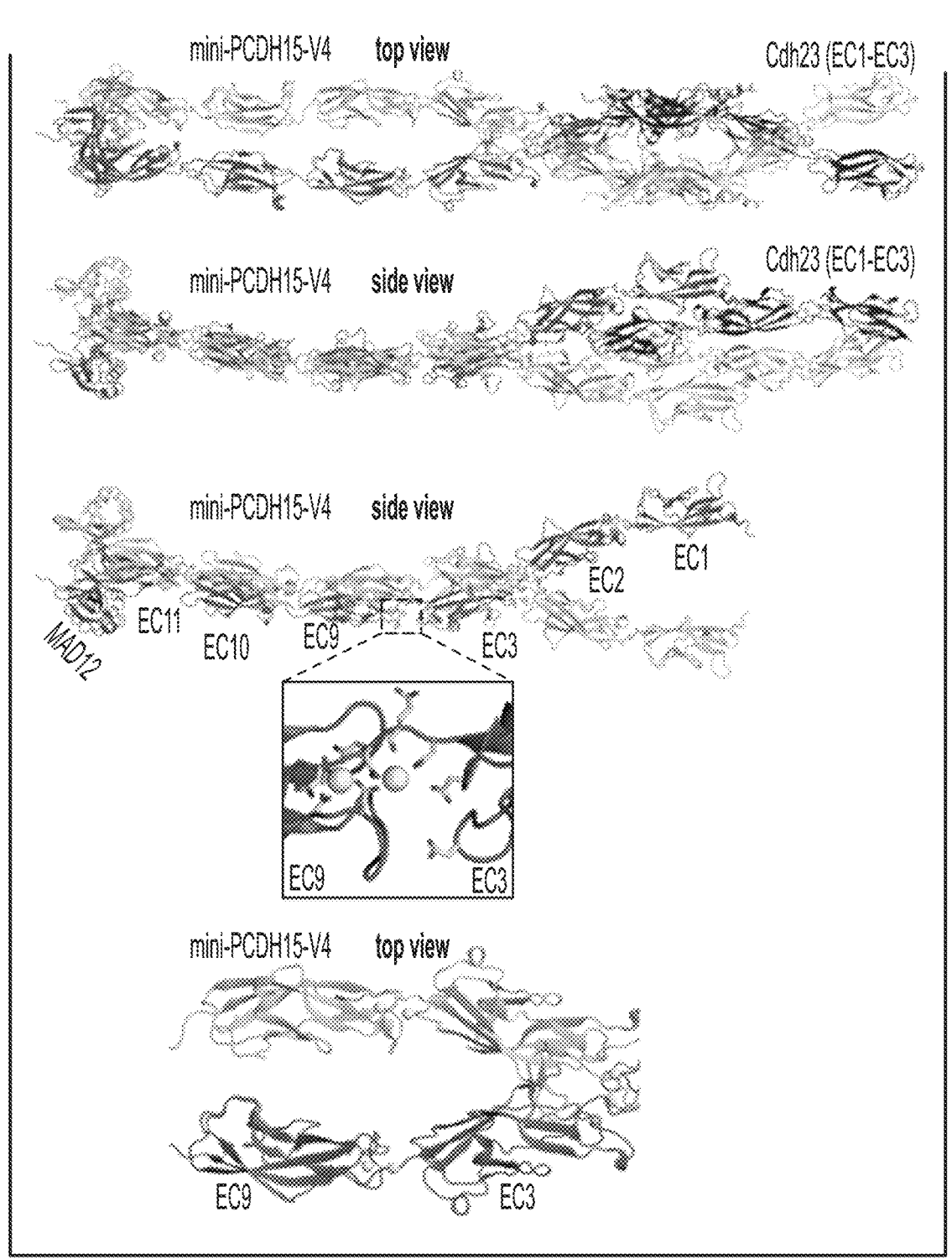
FIGS. 5A-5C show structural modeling of the effect of the linkers between EC domains in mini-PCDH15 proteins.

The effect of the linkers between EC domains on the function of the mini-PCDH15 were investigated by structural modeling. mini-PCDH15 Version 4, 7, and 8—the same versions tested in mice for their abilities to rescue hearing in Example 1 (FIGS. 3B-3E) were modeled. Interestingly, both V4 (FIG. 5A) and V7 (FIG. 5B) modeled well, and were predicted to retain the overall structural architecture of the full length PCDH15.

Figures 5B, 5C:
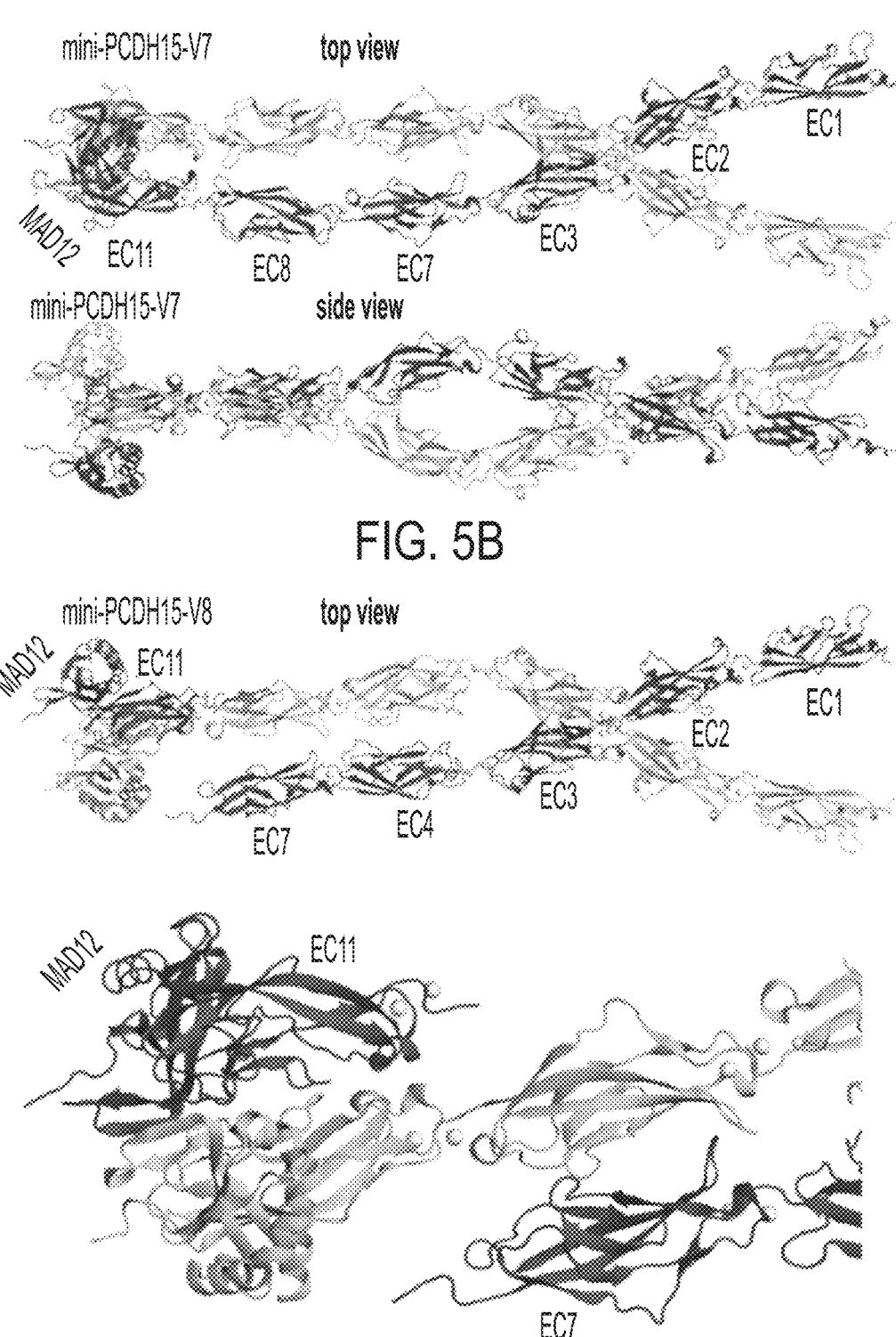

In contrast, the structural modeling for V8 suggested that the artificial connections within the mini-PCDH15-V8, which did not show rescue in the mouse ear, are positioning the EC domains at angles that would likely affect the 2-point protein dimerization (FIG. 5C). The structural modeling suggested that in order to have two dimerization points along the mini-PCDH15-v8 molecule, the EC11-MAD12 domains must be positioned away from the EC7. And the chain linking EC7 and EC11 is disrupted, suggesting that that linker is not sufficient to span the gap to enable a proper positioning (FIG. 5C). The modeling results suggested that the possibility of V8 to form a functional dimeric structure is low, which is consistent with the data obtained from ABR testing showing that mini-PCDH15 V8 at its current state is unable to rescue hearing. However, the linkers between artificially connected EC domains can be engineered to confer desired flexibility or Ca binding capacity. Some of the amino acid residues of the linkers can be replaced by amino acids S, A, G, or N, or amino acids S, A, G, or N can be added to the linker sequence to alter flexibility. A chimeric linker may be formed (e.g., to link EC3 and EC5, a chimeric linker between EC3 linker and EC4 linker can be engineered). Any of the mini-PCDH15 described herein may have altered linker sequence replacing the current linker sequences connecting the EC domains. Non-limiting examples of chimeric linkers between the artificially connected domains are shown in Table 3. It is known in the art that the second amino acid is not conserved and may not be crucial to linker function, therefore the second amino acid residual of the linker are shown as X, which can be any amino acid (e.g., R, G, E, A, P, V, I, M, P, E, V, or Q). Further, any of the known linkers can be used in connecting the EC domains of a miniPCDH15. Non-limiting examples of known linkers include: GGGSGGG (SEQ ID NO: 139), GGSGG (SEQ ID NO: 140), DGNDN (SEQ ID NO: 141), DGNNN (SEQ ID NO: 142), DANDN (SEQ ID NO: 122), DANNN(SEQ ID NO: 143), GGNDN(SEQ ID NO: 144), GGNNN(SEQ ID NO: 145), GGSNN(SEQ ID NO: 146), GGSAA (SEQ ID NO: 147), AANDN(SEQ ID NO: 148), AANNN(SEQ ID NO: 149).

Example 3: Correction of c.773C>T Mutation in Genomic DNA with Base Editor

Approximately 1% of Ashkenazi Jewish individuals carry a single C·G-to-T·A mutation in exon 8 of PCDH15 (Brownstein et al., 2004). This alters the coding sequence to replace residue R245 with a stop codon (Ben-Yosef et al., 2003).

About 1 in 40,000 offspring are homozygous, and the R245X mutation truncates the PCDH15 protein, eliminating function and producing Usher 1F. Fortunately, the single base pair mutation which causes the R245X mutation makes it a suitable candidate for gene editing by ABEmax (Koblan et al., 2018).

Figure 2A:
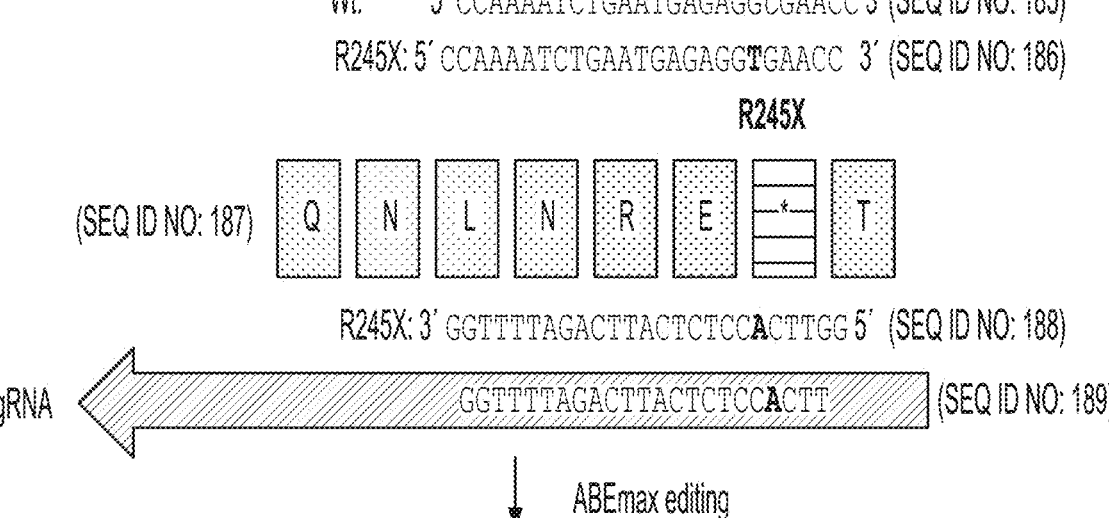
FIGS. 2A-2F show base editing at the PCDH15 c.733C>T locus.

To optimize gRNA sequences, base editor is first tested on the c.733C>T (p.R245X) mutation in vitro. Using lentivirus, a stable HEK293T cell line carrying 2 kb of the human PCDH15 cDNA, bearing the R245X mutation and encoding N-terminal FLAG and C-terminal MYC epitopes was generated by lentiviral transduction. These cells are transfected with the adenosine base editor (ABEmax, ABE7.1 and ABE 8e) along with the designed gRNAs to target the mutated base pair (FIG. 2A). Sequences of vectors encoding the gRNA are shown below in Table 5:

| SEQ ID NO: | Vector | Sequence |
|---|---|---|
| 173 | JL42_gRNA 1_ALT | GACGTCGCTAGCTGTACAAAAAAGC AGGCTTTAAAGGAACCAATTCAGTC GACTGGATCCGGTACCAAGGTCGGG CAGGAAGAGGGCCTATTTCCCATGA TTCCTTCATATTTGCATATACGATA CAAGGCTGTTAGAGAGATAATTAGA ATTAATTTGACTGTAAACACAAAGA TATTAGTACAAAATACGTGACGTAG AAAGTAATAATTTCTTGGGTAGTTT GCAGTTTTAAAATTATGTTTTAAAA TGGACTATCATATGCTTACCGTAAC TTGAAAGTATTTCGATTTCTTGGCT TTATATATCTTGTGGAAAGGACGAA ACACCGGTGGTGGTTCACCTCTCAT TGTTTTAGAGCTAGAAATAGCAAGT TAAAATAAGGCTAGTCCGTTATCAA CTTGAAAAAGTGGCACCGAGTCGGT GCTTTTTTAAGCTTGGGCCGCTCG AGGTACCTCTCTACATATGACATGT GAGCAAAAGGCCAGCAAAAGGCCAG GAACCGTAAAAAGGCCGCGTTGCTG GCGTTTTTCCATAGGCTCCGCCCCC CTGACGAGCATCACAAAAATCGACG CTCAAGTCAGAGGTGGCGAAACCCG ACAGGACTATAAAGATACCAGGCGT TTCCCCCTGGAAGCTCCCTCGTGCG CTCTCCTGTTCCGACCCTGCCGCTT ACCGGATACCTGTCCGCCTTTCTCC CTTCGGGAAGCGTGGCGCTTTCTCA TAGCTCACGCTGTAGGTATCTCAGT TCGGTGTAGGTCGTTCGCTCCAAGC TGGGCTGTGTGCACGAACCCCCCGT TCAGCCCGACCGCTGCGCCTTATCC GGTAACTATCGTCTTGAGTCCAACC CGGTAAGACACGACTTATCGCCACT GGCAGCAGCCACTGGTAACAGGATT AGCAGAGCGAGGTATGTAGGCGGTG CTACAGAGTTCTTGAAGTGGTGGCC TAACTACGGCTACACTAGAAGAACA GTATTTGGTATCTGCGCTCTGCTGA AGCCAGTTACCTTCGGAAAAAGAGT TGGTAGCTCTTGATCCGGCAAACAA ACCACCGCTGGTAGCGGTGGTTTTT TTGTTTGCAAGCAGCAGATTACGCG CAGAAAAAAAGGATCTCAAGAAGAT CCTTTGATCTTTTCTACGGGGTCTG ACGCTCAGTGGAACGAAAACTCACG TTAAGGGATTTTGGTCATGAGATTA TCAAAAAGGATCTTCACCTAGATCC TTTTAAATTAAAAATGAAGTTTTAA ATCAATCTAAAGTATATATGAGTAA ACTTGGTCTGACAGTTACCAATGCT TAATCAGTGAGGCACCTATCTCAGC GATCTGTCTATTTCGTTCATCCATA GTTGCCTGACTCCCCGTCGTGTAGA TAACTACGATACGGGAGGGCTTACC |

-continued

-continued

| SEQ ID NO: | Vector | Sequence |
|---|---|---|
| | | ATCTGGCCCCAGTGCTGCAATGATA |
| | | CCGCGAGACCCACGCTCACCGGCTC |
| | | CAGATTTATCAGCAATAAACCAGCC |
| | | AGCCGGAAGGGCCGAGCGCAGAAGT |
| | | GGTCCTGCAACTTTATCCGCCTCCA |
| | | TCCAGTCTATTAATTGTTGCCGGGA |
| | | AGCTAGAGTAAGTAGTTCGCCAGTT |
| | | AATAGTTTGCGCAACGTTGTTGCCA |
| | | TTGCTACAGGCATCGTGGTGTCACG |
| | | CTCGTCGTTTGGTATGGCTTCATTC |
| | | AGCTCCGGTTCCCAACGATCAAGGC |
| | | GAGTTACATGATCCCCATGTTGTG |
| | | CAAAAAAGCGGTTAGCTCCTTCGGT |
| | | CCTCCGATCGTTGTCAGAAGTAAGT |
| | | TGGCCGCAGTGTTATCACTCATGGT |
| | | TATGGCAGCACTGCATAATTCTCTT |
| | | ACTGTCATGCCATCCGTAAGATGCT |
| | | TTTCTGTGACTGGTGAGTACTCAAC |
| | | CAAGTCATTCTGAGAATAGTGTATG |
| | | CGGCGACCGAGTTGCTCTTGCCCGG |
| | | CGTCAATACGGGATAATACCGCGCC |
| | | ACATAGCAGAACTTTAAAAGTGCTC |
| | | ATCATTGGAAAACGTTCTTCGGGGC |
| | | GAAAACTCTCAAGGATCTTACCGCT |
| | | GTTGAGATCCAGTTCGATGTAACCC |
| | | ACTCGTGCACCCAACTGATCTTCAG |
| | | CATCTTTTACTTTCACCAGCGTTTC |
| | | TGGGTGAGCAAAAACAGGAAGGCAA |
| | | AATGCCGCAAAAAAGGGAATAAGGG |
| | | CGACACGGAAATGTTGAATACTCAT |
| | | ACTCTTCCTTTTTCAATATTATTGA |
| | | AGCATTTATCAGGGTTATTGTCTCA |
| | | TGAGCGGATACATATTTGAATGTAT |
| | | TTAGAAAAATAAACAAATAGGGGTT |
| | | CCGCGCACATTTCCCCGAAAAGTGC |
| | | CACCT |
| 174 | JL42_gRNA 1 + 1 | GACGTCGCTAGCTGTACAAAAAAGC |
| | | AGGCTTTAAAGGAACCAATTCAGTC |
| | | GACTGGATCCGGTACCAAGGTCGGG |
| | | CAGGAAGAGGGCCTATTTCCCATGA |
| | | TTCCTTCATATTTGCATATACGATA |
| | | CAAGGCTGTTAGAGAGATAATTAGA |
| | | ATTAATTTGACTGTAAACACAAAGA |
| | | TATTAGTACAAAATACGTGACGTAG |
| | | AAAGTAATAATTTCTTGGGTAGTTT |
| | | GCAGTTTTAAAATTATGTTTTAAA |
| | | TGGACTATCATATGCTTACCGTAAC |
| | | TTGAAAGTATTTCGATTTCTTGGCT |
| | | TTATATATCTTGTGGAAAGGACGAA |
| | | ACACCGGTTCACCTCTCATTCAGAT |
| | | TTGTTTTAGAGCTAGAAATAGCAAG |
| | | TTAAAATAAGGCTAGTCCGTTATCA |
| | | ACTTGAAAAAGTGGCACCGAGTCGG |
| | | TGCTTTTTTTAAGCTTGGGCCGCTC |
| | | GAGGTACCTCTCTACATATGACATG |
| | | TGAGCAAAAGGCCAGCAAAAGGCCA |
| | | GGAACCGTAAAAAGGCCGCGTTGCT |
| | | GGCGTTTTTCCATAGGCTCCGCCCC |
| | | CCTGACGAGCATCACAAAAATCGAC |
| | | GCTCAAGTCAGAGGTGGCGAAACCC |
| | | GACAGGACTATAAAGATACCAGGCG |
| | | TTTCCCCCTGGAAGCTCCCTCGTGC |
| | | GCTCTCCTGTTCCGACCCTGCCGCT |
| | | TACCGGATACCTGTCCGCCTTTCTC |
| | | CCTTCGGGAAGCGTGGCGCTTTCTC |
| | | ATAGCTCACGCTGTAGGTATCTCAG |
| | | TTCGGTGTAGGTCGTTCGCTCCAAG |
| | | CTGGGCTGTGTGCACGAACCCCCCG |
| | | TTCAGCCCGACCGCTGCGCCTTATC |
| | | CGGTAACTATCGTCTTGAGTCCAAC |
| | | CCGGTAAGACACGACTTATCGCCAC |
| | | TGGCAGCAGCCACTGGTAACAGGAT |
| | | TAGCAGAGCGAGGTATGTAGGCGGT |
| | | GCTACAGAGTTCTTGAAGTGGTGGC |

| SEQ ID NO: | Vector | Sequence |
|---|---|---|
| | | CTAACTACGGCTACACTAGAAGAAC |
| | | AGTATTTGGTATCTGCGCTCTGCTG |
| | | AAGCCAGTTACCTTCGGAAAAAGAG |
| | | TTGGTAGCTCTTGATCCGGCAAACA |
| | | AACCACCGCTGGTAGCGGTGGTTTT |
| | | TTTGTTTGCAAGCAGCAGATTACGC |
| | | GCAGAAAAAAAGGATCTCAAGAAGA |
| | | TCCTTTGATCTTTTCTACGGGGTCT |
| | | GACGCTCAGTGGAACGAAAACTCAC |
| | | GTTAAGGGATTTTGGTCATGAGATT |
| | | ATCAAAAAGGATCTTCACCTAGATC |
| | | CTTTTTAAATTAAAAATGAAGTTTTA |
| | | AATCAATCTAAAGTATATATGAGTA |
| | | AACTTGGTCTGACAGTTACCAATGC |
| | | TTAATCAGTGAGGCACCTATCTCAG |
| | | CGATCTGTCTATTTCGTTCATCCAT |
| | | AGTTGCCTGACTCCCCGTCGTGTAG |
| | | ATAACTACGATACGGGAGGGCTTAC |
| | | CATCTGGCCCCAGTGCTGCAATGAT |
| | | ACCGCGAGACCCACGCTCACCGGCT |
| | | CCAGATTTATCAGCAATAAACCAGC |
| | | CAGCCGGAAGGGCCGAGCGCAGAAG |
| | | TGGTCCTGCAACTTTATCCGCCTCC |
| | | ATCCAGTCTATTAATTGTTGCCGGG |
| | | AAGCTAGAGTAAGTAGTTCGCCAGT |
| | | TAATAGTTTGCGCAACGTTGTTGCC |
| | | ATTGCTACAGGCATCGTGGTGTCAC |
| | | GCTCGTCGTTTGGTATGGCTTCATT |
| | | CAGCTCCGGTTCCCAACGATCAAGG |
| | | CGAGTTACATGATCCCCATGTTGT |
| | | GCAAAAAAGCGGTTAGCTCCTTCGG |
| | | TCCTCCGATCGTTGTCAGAAGTAAG |
| | | TTGGCCGCAGTGTTATCACTCATGG |
| | | TTATGGCAGCACTGCATAATTCTCT |
| | | TACTGTCATGCCATCCGTAAGATGC |
| | | TTTTCTGTGACTGGTGAGTACTCAA |
| | | CCAAGTCATTCTGAGAATAGTGTAT |
| | | GCGGCGACCGAGTTGCTCTTGCCCG |
| | | GCGTCAATACGGGATAATACCGCGC |
| | | CACATAGCAGAACTTTAAAAGTGCT |
| | | CATCATTGGAAAACGTTCTTCGGGG |
| | | CGAAAACTCTCAAGGATCTTACCGC |
| | | TGTTGAGATCCAGTTCGATGTAACC |
| | | CACTCGTGCACCCAACTGATCTTCA |
| | | GCATCTTTTACTTTCACCAGCGTTT |
| | | CTGGGTGAGCAAAAACAGGAAGGCA |
| | | AATGCCGCAAAAAAGGGAATAAGG |
| | | GCGCACACGAAATGTTGAATACTCA |
| | | TACTCTTCCTTTTTCAATATTATTG |
| | | AAGCATTTATCAGGGTTATTGTCTC |
| | | ATGAGCGGATACATATTTGAATGTAT |
| | | TTTAGAAAAATAAACAAATAGGGGT |
| | | TCCGCGCACATTTCCCCGAAAAGTG |
| | | CCACCT |
| 175 | JL42_gRNA 1 + 2 | GACGTCGCTAGCTGTACAAAAAAGC |
| | | AGGCTTTAAAGGAACCAATTCAGTC |
| | | GACTGGATCCGGTACCAAGGTCGGG |
| | | CAGGAAGAGGGCCTATTTCCCATGA |
| | | TTCCTTCATATTTGCATATACGATA |
| | | CAAGGCTGTTAGAGAGATAATTAGA |
| | | ATTAATTTGACTGTAAACACAAAGA |
| | | TATTAGTACAAAATACGTGACGTAG |
| | | AAAGTAATAATTTCTTGGGTAGTTT |
| | | GCAGTTTTAAAATTATGTTTTAAA |
| | | TGGACTATCATATGCTTACCGTAAC |
| | | TTGAAAGTATTTCGATTTCTTGGCT |
| | | TTATATATCTTGTGGAAAGGACGAA |
| | | ACACCGGTTCACCTCTCATTCAGA |
| | | TTTGTTTTAGAGCTAGAAATAGCAA |
| | | GTTAAAATAAGGCTAGTCCGTTATC |
| | | AACTTGAAAAAGTGGCACCGAGTCG |
| | | GTGCTTTTTTTAAGCTTGGGCCGCT |
| | | CGAGGTACCTCTCTACATATGACAT |
| | | GTGAGCAAAAGGCCAGCAAAAGGCC |

-continued

-continued

| SEQ ID NO: | Vector | Sequence |
|---|---|---|
| | | AGGAACCGTAAAAAGGCCGCGTTGC |
| | | TGGCGTTTTTCCATAGGCTCCGCCC |
| | | CCCTGACGAGCATCACAAAAATCGA |
| | | CGCTCAAGTCAGAGGTGGCGAAACC |
| | | CGACAGGACTATAAAGATACCAGGC |
| | | GTTTCCCCCTGGAAGCTCCCTCGTG |
| | | CGCTCTCCTGTTCCGACCCTGCCGC |
| | | TTACCGGATACCTGTCCGCCTTTCT |
| | | CCCTTCGGGAAGCGTGGCGCTTTCT |
| | | CATAGCTCACGCTGTAGGTATCTCA |
| | | GTTCGGTGTAGGTCGTTCGCTCCAA |
| | | GCTGGGCTGTGTGCACGAACCCCCC |
| | | GTTCAGCCCGACCGCTGCGCCTTAT |
| | | CCGGTAACTATCGTCTTGAGTCCAA |
| | | CCCGGTAAGACACGACTTATCGCCA |
| | | CTGGCAGCAGCCACTGGTAACAGGA |
| | | TTAGCAGAGCGAGGTATGTAGGCGG |
| | | TGCTACAGAGTTCTTGAAGTGGTGG |
| | | CCTAACTACGGCTACACTAGAAGAA |
| | | CAGTATTTGGTATCTGCGCTCTGCT |
| | | GAAGCCAGTTACCTTCGGAAAAAGA |
| | | GTTGGTAGCTCTTGATCCGGCAAAC |
| | | AAACCACCGCTGGTAGCGGTGGTTT |
| | | TTTTGTTTGCAAGCAGCAGATTACG |
| | | CGCAGAAAAAAGGATCTCAAGAAG |
| | | ATCCTTTGATCTTTTCTACGGGGTC |
| | | TGACGCTCAGTGGAACGAAAACTCA |
| | | CGTTAAGGGATTTTGGTCATGAGAT |
| | | TATCAAAAAGGATCTTCACCTAGAT |
| | | CCTTTTAAATTAAAAATGAAGTTTT |
| | | AAATCAATCTAAAGTATATATGAGT |
| | | AAACTTGGTCTGACAGTTACCAATG |
| | | CTTAATCAGTGAGGCACCTATCTCA |
| | | GCGATCTGTCTATTTCGTTCATCCA |
| | | TAGTTGCCTGACTCCCCGTCGTGTA |
| | | GATAACTACGATACGGGAGGGCTTA |
| | | CCATCTGGCCCCAGTGCTGCAATGA |
| | | TACCGCGAGACCCACGCTCACCGGC |
| | | TCCAGATTTATCAGCAATAAACCAG |
| | | CCAGCCGGAAGGGCCGAGCGCAGAA |
| | | GTGGTCCTGCAACTTTATCCGCCTC |
| | | CATCCAGTCTATTAATTGTTGCCGG |
| | | GAAGCTAGAGTAAGTAGTTCGCCAG |
| | | TTAATAGTTTGCGCAACGTTGTTGC |
| | | CATTGCTACAGGCATCGTGGTGTCA |
| | | CGCTCGTCGTTTGGTATGGCTTCAT |
| | | TCAGCTCCGGTTCCCAACGATCAAG |
| | | GCGAGTTACATGATCCCCCATGTTG |
| | | TGCAAAAAAGCGGTTAGCTCCTTCG |
| | | GTCCTCCGATCGTTGTCAGAAGTAA |
| | | GTTGGCCGCAGTGTTATCACTCATG |
| | | GTTATGGCAGCACTGCATAATTCTC |
| | | TTACTGTCATGCCATCCGTAAGATG |
| | | CTTTTTCTGTGACTGGTGAGTACTCA |
| | | ACCAAGTCATTCTGAGAATAGTGTA |
| | | TGCGGCGACCGAGTTGCTCTTGCCC |
| | | GGCGTCAATACGGGATAATACCGCG |
| | | CCACATAGCAGAACTTTAAAAGTGC |
| | | TCATCATTGGAAAACGTTCTTCGGG |
| | | GCGAAAACTCTCAAGGATCTTACCG |
| | | CTGTTGAGATCCAGTTCGATGTAAC |
| | | CCACTCGTGCACCCAACTGATCTTC |
| | | AGCATCTTTTACTTTCACCAGCGTT |
| | | TCTGGGTGAGCAAAAACAGGAAGGC |
| | | AAAATGCCGCAAAAAAGGGAATAAG |
| | | GGCGACACGGAAATGTTGAATACTC |
| | | ATACTCTTCCTTTTTCAATATTATT |
| | | GAAGCATTTATCAGGGTTATTGTCT |
| | | CATGAGCGGATACATATTTGAATGT |
| | | ATTTAGAAAAATAAACAAATAGGGG |
| | | TTCCGCGCACATTTCCCCGAAAAGT |
| | | GCCACCT |
| 176 | JL42_gRNA 1 + 3 | GACGTCGCTAGCTGTACAAAAAAGC AGGCTTTAAAGGAACCAATTCAGTC |
| | | GACTGGATCCGGTACCAAGGTCGGG |
| | | CAGGAAGAGGGCCTATTTCCCATGA |
| | | TTCCTTCATATTTGCATATACGATA |
| | | CAAGGCTGTTAGAGAGATAATTAGA |
| | | ATTAATTTGACTGTAAACACAAAGA |
| | | TATTAGTACAAAATACGTGACGTAG |
| | | AAAGTAATAATTTCTTGGGTAGTTT |
| | | GCAGTTTTAAAATTATGTTTTAAAA |
| | | TGGACTATCATATGCTTACCGTAAC |
| | | TTGAAAGTATTTCGATTTCTTGGCT |
| | | TTATATATCTTGTGGAAAGGACGAA |
| | | ACACCGTGGTTCACCTCTCATTCAG |
| | | ATTTGTTTTAGAGCTAGAAATAGCA |
| | | AGTTAAAATAAGGCTAGTCCGTTAT |
| | | CAACTTGAAAAAGTGGCACCGAGTC |
| | | GGTGCTTTTTTTAAGCTTGGGCCGC |
| | | TCGAGGTACCTCTCTACATATGACA |
| | | TGTGAGCAAAAGGCCAGCAAAAGGC |
| | | CAGGAACCGTAAAAAGGCCGCGTTG |
| | | CTGGCGTTTTTCCATAGGCTCCGCC |
| | | CCCCTGACGAGCATCACAAAAATCG |
| | | ACGCTCAAGTCAGAGGTGGCGAAAC |
| | | CCGACAGGACTATAAAGATACCAGG |
| | | CGTTTCCCCCTGGAAGCTCCCTCGT |
| | | GCGCTCTCCTGTTCCGACCCTGCCG |
| | | CTTACCGGATACCTGTCCGCCTTTC |
| | | TCCCTTCGGGAAGCGTGGCGCTTTC |
| | | TCATAGCTCACGCTGTAGGTATCTC |
| | | AGTTCGGTGTAGGTCGTTCGCTCCA |
| | | AGCTGGGCTGTGTGCACGAACCCCC |
| | | CGTTCAGCCCGACCGCTGCGCCTTA |
| | | TCCGGTAACTATCGTCTTGAGTCCA |
| | | ACCCGGTAAGACACGACTTATCGCC |
| | | ACTGGCAGCAGCCACTGGTAACAGG |
| | | ATTAGCAGAGCGAGGTATGTAGGCG |
| | | GTGCTACAGAGTTCTTGAAGTGGTG |
| | | GCCTAACTACGGCTACACTAGAAGA |
| | | ACAGTATTTGGTATCTGCGCTCTGC |
| | | TGAAGCCAGTTACCTTCGGAAAAAG |
| | | AGTTGGTAGCTCTTGATCCGGCAAA |
| | | CAAACCACCGCTGGTAGCGGTGGTT |
| | | TTTTTGTTTGCAAGCAGCAGATTAC |
| | | GCGCAGAAAAAAAGGATCTCAAGAA |
| | | GATCCTTTGATCTTTTCTACGGGGT |
| | | CTGACGCTCAGTGGAACGAAAACTC |
| | | ACGTTAAGGGATTTTGGTCATGAGA |
| | | TTATCAAAAAGGATCTTCACCTAGA |
| | | TCCTTTTAAATTAAAAATGAAGTTT |
| | | TAAATCAATCTAAAGTATATATGAG |
| | | TAAACTTGGTCTGACAGTTACCAAT |
| | | GCTTAATCAGTGAGGCACCTATCTC |
| | | AGCGATCTGTCTATTTCGTTCATCC |
| | | ATAGTTGCCTGACTCCCCGTCGTGT |
| | | AGATAACTACGATACGGGAGGGCTT |
| | | ACCATCTGGCCCCAGTGCTGCAATG |
| | | ATACCGCGAGACCCACGCTCACCGG |
| | | CTCCAGATTTATCAGCAATAAACCA |
| | | GCCAGCCGGAAGGGCCGAGCGCAGA |
| | | AGTGGTCCTGCAACTTTATCCGCCT |
| | | CCATCCAGTCTATTAATTGTTGCCG |
| | | GGAAGCTAGAGTAAGTAGTTCGCCA |
| | | GTTAATAGTTTGCGCAACGTTGTTG |
| | | CCATTGCTACAGGCATCGTGGTGTC |
| | | ACGCTCGTCGTTTGGTATGGCTTCA |
| | | TTCAGCTCCGGTTCCCAACGATCAA |
| | | GGCGAGTTACATGATCCCCCATGTT |
| | | GTGCAAAAAAGCGGTTAGCTCCTTC |
| | | GGTCCTCCGATCGTTGTCAGAAGTA |
| | | AGTTGGCCGCAGTGTTATCACTCAT |
| | | GGTTATGGCAGCACTGCATAATTCT |
| | | CTTACTGTCATGCCATCCGTAAGAT |
| | | GCTTTTTCTGTGACTGGTGAGTACTC |
| | | AACCAAGTCATTCTGAGAATAGTGT |
| | | ATGCGGCGACCGAGTTGCTCTTGCC |
| | | CGGCGTCAATACGGGATAATACCGC |

| | | |
|---|---|---|
| 299 | | 300 |
| -continued | | -continued |

-continued

| SEQ ID NO: | Vector | Sequence |
|---|---|---|
| | | GCCACATAGCAGAACTTTAAAAGTG |
| | | CTCATCATTGGAAAACGTTCTTCGG |
| | | GGCGAAAACTCTCAAGGATCTTACC |
| | | GCTGTTGAGATCCAGTTCGATGTAA |
| | | CCCACTCGTGCACCCAACTGATCTT |
| | | CAGCATCTTTTACTTTCACCAGCGT |
| | | TTCTGGGTGAGCAAAAACAGGAAGG |
| | | CAAAATGCCGCAAAAAAGGGAATAA |
| | | GGGCGACACGGAAATGTTGAATACT |
| | | CATACTCTTCCTTTTTCAATATTAT |
| | | TGAAGCATTTATCAGGGTTATTGTC |
| | | TCATGAGCGGATACATATTTGAATG |
| | | TATTTAGAAAAATAAACAAATAGGG |
| | | GTTCCGCGCACATTTCCCCGAAAAG |
| | | TGCCACCT |
| 177 | JL42_gRNA 1 – 1 | GACGTCGCTAGCTGTACAAAAAAGC |
| | | AGGCTTTAAAGGAACCAATTCAGTC |
| | | GACTGGATCCGGTACCAAGGTCGGG |
| | | CAGGAAGAGGGCCTATTTCCCATGA |
| | | TTCCTTCATATTTGCATATACGATA |
| | | CAAGGCTGTTAGAGAGATAATTAGA |
| | | ATTAATTTGACTGTAAACACAAAGA |
| | | TATTAGTACAAAATACGTGACGTAG |
| | | AAAGTAATAATTTCTTGGGTAGTTT |
| | | GCAGTTTTAAAATTATGTTTTAAAA |
| | | TGGACTATCATATGCTTACCGTAAC |
| | | TTGAAAGTATTTCGATTTCTTGGCT |
| | | TTATATATCTTGTGGAAAGGACGAA |
| | | ACACCGTCACCTCTCATTCAGATTT |
| | | GTTTTAGAGCTAGAAATAGCAAGTT |
| | | AAAATAAGGCTAGTCCGTTATCAAC |
| | | TTGAAAAAGTGGCACCGAGTCGGTG |
| | | CTTTTTTTAAGCTTGGGCCGCTCGA |
| | | GGTACCTCTCTACATATGACATGTG |
| | | AGCAAAAGGCCAGCAAAAGGCCAGG |
| | | AACCGTAAAAAGGCCGCGTTGCTGG |
| | | CGTTTTTCCATAGGCTCCGCCCCCC |
| | | TGACGAGCATCACAAAAATCGACGC |
| | | TCAAGTCAGAGGTGGCGAAACCCGA |
| | | CAGGACTATAAAGATACCAGGCGTT |
| | | TCCCCCTGGAAGCTCCCTCGTGCGC |
| | | TCTCCTGTTCCGACCCTGCCGCTTA |
| | | CCGGATACCTGTCCGCCTTTCTCCC |
| | | TTCGGGAAGCGTGGCGCTTTCTCAT |
| | | AGCTCACGCTGTAGGTATCTCAGTT |
| | | CGGTGTAGGTCGTTCGCTCCAAGCT |
| | | GGGCTGTGTGCACGAACCCCCCGTT |
| | | CAGCCCGACCGCTGCGCCTTATCCG |
| | | GTAACTATCGTCTTGAGTCCAACCC |
| | | GGTAAGACACGACTTATCGCCACTG |
| | | GCAGCAGCCACTGGTAACAGGATTA |
| | | GCAGAGCGAGGTATGTAGGCGGTGC |
| | | TACAGAGTTCTTGAAGTGGTGGCCT |
| | | AACTACGGCTACACTAGAAGAACAG |
| | | TATTTGGTATCTGCGCTCTGCTGAA |
| | | GCCAGTTACCTTCGGAAAAAGAGTT |
| | | GGTAGCTCTTGATCCGGCAAACAAA |
| | | CCACCGCTGGTAGCGGTGGTTTTTT |
| | | TGTTTGCAAGCAGCAGATTACGCGC |
| | | AGAAAAAAAGGATCTCAAGAAGATC |
| | | CTTTGATCTTTTCTACGGGGTCTGA |
| | | CGCTCAGTGGAACGAAAACTCACGT |
| | | TAAGGGATTTTGGTCATGAGATTAT |
| | | CAAAAAGGATCTTCACCTAGATCCT |
| | | TTTAAATTAAAAATGAAGTTTTAAA |
| | | TCAATCTAAAGTATATATGAGTAAA |
| | | CTTGGTCTGACAGTTACCAATGCTT |
| | | AATCAGTGAGGCACCTATCTCAGCG |
| | | ATCTGTCTATTTCGTTCATCCATAG |
| | | TTGCCTGACTCCCCGTCGTGTAGAT |
| | | AACTACGATACGGGAGGGCTTACCA |
| | | TCTGGCCCCAGTGCTGCAATGATAC |
| | | CGCGAGACCCACGCTCACCGGCTCC |
| | | AGATTTATCAGCAATAAACCAGCCA |

| SEQ ID NO: | Vector | Sequence |
|---|---|---|
| | | GCCGGAAGGGCCGAGCGCAGAAGTG |
| | | GTCCTGCAACTTTATCCGCCTCCAT |
| | | CCAGTCTATTAATTGTTGCCGGGAA |
| | | GCTAGAGTAAGTAGTTCGCCAGTTA |
| | | ATAGTTTGCGCAACGTTGTTGCCAT |
| | | TGCTACAGGCATCGTGGTGTCACGC |
| | | TCGTCGTTTGGTATGGCTTCATTCA |
| | | GCTCCGGTTCCCAACGATCAAGGCG |
| | | AGTTACATGATCCCCCATGTTGTGC |
| | | AAAAAAGCGGTTAGCTCCTTCGGTC |
| | | CTCCGATCGTTGTCAGAAGTAAGTT |
| | | GGCCGCAGTGTTATCACTCATGGTT |
| | | ATGGCAGCACTGCATAATTCTCTTA |
| | | CTGTCATGCCATCCGTAAGATGCTT |
| | | TTCTGTGACTGGTGAGTACTCAACC |
| | | AAGTCATTCTGAGAATAGTGTATGC |
| | | GGCGACCGAGTTGCTCTTGCCCGGC |
| | | GTCAATACGGGATAATACCGCGCCA |
| | | CATAGCAGAACTTTAAAAGTGCTCA |
| | | TCATTGGAAAACGTTCTTCGGGGCG |
| | | AAAACTCTCAAGGATCTTACCGCTG |
| | | TTGAGATCCAGTTCGATGTAACCCA |
| | | CTCGTGCACCCAACTGATCTTCAGC |
| | | ATCTTTTACTTTCACCAGCGTTTCT |
| | | GGGTGAGCAAAAACAGGAAGGCAAA |
| | | ATGCCGCAAAAAAGGGAATAAGGGC |
| | | GACACGAAATGTTGAATACTCATA |
| | | CTCTTCCTTTTTCAATATTATTGAA |
| | | GCATTTATCAGGGTTATTGTCTCAT |
| | | GAGCGGATACATATTTGAATGTATT |
| | | TAGAAAAATAAACAAATAGGGGTTC |
| | | CGCGCACATTTCCCCGAAAAGTGCC |
| | | ACCT |
| 178 | JL42_gRNA 1 – 2 | GACGTCGCTAGCTGTACAAAAAAGC |
| | | AGGCTTTAAAGGAACCAATTCAGTC |
| | | GACTGGATCCGGTACCAAGGTCGGG |
| | | CAGGAAGAGGGCCTATTTCCCATGA |
| | | TTCCTTCATATTTGCATATACGATA |
| | | CAAGGCTGTTAGAGAGATAATTAGA |
| | | ATTAATTTGACTGTAAACACAAAGA |
| | | TATTAGTACAAAATACGTGACGTAG |
| | | AAAGTAATAATTTCTTGGGTAGTTT |
| | | GCAGTTTTAAAATTATGTTTTAAAA |
| | | TGGACTATCATATGCTTACCGTAAC |
| | | TTGAAAGTATTTCGATTTCTTGGCT |
| | | TTATATATCTTGTGGAAAGGACGAA |
| | | ACACCGCACCTCTCATTCAGATTTG |
| | | TTTTAGAGCTAGAAATAGCAAGTTA |
| | | AAATAAGGCTAGTCCGTTATCAACT |
| | | TGAAAAAGTGGCACCGAGTCGGTGC |
| | | TTTTTTTAAGCTTGGGCCGCTCGAG |
| | | GTACCTCTCTACATATGACATGTGA |
| | | GCAAAAGGCCAGCAAAAGGCCAGGA |
| | | ACCGTAAAAAGGCCGCGTTGCTGGC |
| | | GTTTTTCCATAGGCTCCGCCCCCCT |
| | | GACGAGCATCACAAAAATCGACGCT |
| | | CAAGTCAGAGGTGGCGAAACCCGAC |
| | | AGGACTATAAAGATACCAGGCGTTT |
| | | CCCCCTGGAAGCTCCCTCGTGCGCT |
| | | CTCCTGTTCCGACCCTGCCGCTTAC |
| | | CGGATACCTGTCCGCCTTTCTCCCT |
| | | TCGGGAAGCGTGGCGCTTTCTCATA |
| | | GCTCACGCTGTAGGTATCTCAGTTC |
| | | GGTGTAGGTCGTTCGCTCCAAGCTG |
| | | GGCTGTGTGCACGAACCCCCCGTTC |
| | | AGCCCGACCGCTGCGCCTTATCCGG |
| | | TAACTATCGTCTTGAGTCCAACCCG |
| | | GTAAGACACGACTTATCGCCACTGG |
| | | CAGCAGCCACTGGTAACAGGATTAG |
| | | CAGAGCGAGGTATGTAGGCGGTGCT |
| | | ACAGAGTTCTTGAAGTGGTGGCCTA |
| | | ACTACGGCTACACTAGAAGAACAGT |
| | | ATTTGGTATCTGCGCTCTGCTGAAG |
| | | CCAGTTACCTTCGGAAAAAGAGTTG |

-continued

| SEQ ID NO: | Vector | Sequence |
|---|---|---|
| | | GTAGCTCTTGATCCGGCAAACAAAC |
| | | CACCGCTGGTAGCGGTGGTTTTTTT |
| | | GTTTGCAAGCAGCAGATTACGCGCA |
| | | GAAAAAAAGGATCTCAAGAAGATCC |
| | | TTTGATCTTTTCTACGGGGTCTGAC |
| | | GCTCAGTGGAACGAAAACTCACGTT |
| | | AAGGGATTTTGGTCATGAGATTATC |
| | | AAAAAGGATCTTCACCTAGATCCTT |
| | | TTAAATTAAAAATGAAGTTTTAAAT |
| | | CAATCTAAAGTATATATGAGTAAAC |
| | | TTGGTCTGACAGTTACCAATGCTTA |
| | | ATCAGTGAGGCACCTATCTCAGCGA |
| | | TCTGTCTATTTCGTTCATCCATAGT |
| | | TGCCTGACTCCCCGTCGTGTAGATA |
| | | ACTACGATACGGGAGGGCTTACCAT |
| | | CTGGCCCCAGTGCTGCAATGATACC |
| | | GCGAGACCCACGCTCACCGGCTCCA |
| | | GATTTATCAGCAATAAACCAGCCAG |
| | | CCGGAAGGGCCGAGCGCAGAAGTGG |
| | | TCCTGCAACTTTATCCGCCTCCATC |
| | | CAGTCTATTAATTGTTGCCGGGAAG |
| | | CTAGAGTAAGTAGTTCGCCAGTTAA |
| | | TAGTTTGCGCAACGTTGTTGCCATT |
| | | GCTACAGGCATCGTGGTGTCACGCT |
| | | CGTCGTTTGGTATGGCTTCATTCAG |
| | | CTCCGGTTCCCAACGATCAAGGCGA |
| | | GTTACATGATCCCCCATGTTGTGCA |
| | | AAAAAGCGGTTAGCTCCTTCGGTCC |
| | | TCCGATCGTTGTCAGAAGTAAGTTG |
| | | GCCGCAGTGTTATCACTCATGGTTA |
| | | TGGCAGCACTGCATAATTCTCTTAC |
| | | TGTCATGCCATCCGTAAGATGCTTT |
| | | TCTGTGACTGGTGAGTACTCAACCA |
| | | AGTCATTCTGAGAATAGTGTATGCG |
| | | GCGACCGAGTTGCTCTTGCCCGGCG |
| | | TCAATACGGGATAATACCGCGCCAC |
| | | ATAGCAGAACTTTAAAAGTGCTCAT |
| | | CATTGGAAAACGTTCTTCGGGGCGA |
| | | AAACTCTCAAGGATCTTACCGCTGT |
| | | TGAGATCCAGTTCGATGTAACCCAC |
| | | TCGTGCACCCAACTGATCTTCAGCA |
| | | TCTTTTACTTTCACCAGCGTTTCTG |
| | | GGTGAGCAAAAACAGGAAGGCAAAA |
| | | TGCCGCAAAAAAGGGAATAAGGGCG |
| | | ACACGGAAATGTTGAATACTCATAC |
| | | TCTTCCTTTTTCAATATTATTGAAG |
| | | CATTTATCAGGGTTATTGTCTCATG |
| | | AGCGGATACATATTTGAATGTATTT |
| | | AGAAAAATAAACAAATAGGGGTTCC |
| | | GCGCACATTTCCCCGAAAAGTGCCA |
| | | CCT |
| 179 | JL42_pFYF gRNA_ABE_ site_5 | GACGTCGCTAGCTGTACAAAAAAGC AGGCTTTAAAGGAACCAATTCAGTC GACTGGATCCGGTACCAAGGTCGGG CAGGAAGAGGGCCTATTTCCCATGA TTCCTTCATATTTGCATATACGATA CAAGGCTGTTAGAGAGATAATTAGA ATTAATTTGACTGTAAACACAAAGA TATTAGTACAAAATACGTGACGTAG AAAGTAATAATTTCTTGGGTAGTTT GCAGTTTTAAAATTATGTTTTAAAA TGGACTATCATATGCTTACCGTAAC TTGAAAGTATTTCGATTTCTTGGCT TTATATATCTTGTGGAAAGGACGAA ACACCGGATGAGATAATGATGAGTC AGTTTTAGAGCTAGAAATAGCAAGT TAAAATAAGGCTAGTCCGTTATCAA CTTGAAAAAGTGGCACCGAGTCGGT GCTTTTTTTAAGCTTGGGCCGCTCG AGGTACCTCTCTACATATGACATGT GAGCAAAAGGCCAGCAAAAGGCCAG GAACCGTAAAAAGGCCGCGTTGCTG GCGTTTTTCCATAGGCTCCGCCCCC CTGACGAGCATCACAAAAATCGACG |

-continued

| SEQ ID NO: | Vector | Sequence |
|---|---|---|
| | | CTCAAGTCAGAGGTGGCGAAACCCG |
| | | ACAGGACTATAAAGATACCAGGCGT |
| | | TTCCCCCTGGAAGCTCCCTCGTGCG |
| | | CTCTCCTGTTCCGACCCTGCCGCTT |
| | | ACCGGATACCTGTCCGCCTTTCTCC |
| | | CTTCGGGAAGCGTGGCGCTTTCTCA |
| | | TAGCTCACGCTGTAGGTATCTCAGT |
| | | TCGGTGTAGGTCGTTCGCTCCAAGC |
| | | TGGGCTGTGTGCACGAACCCCCCGT |
| | | TCAGCCCGACCGCTGCGCCTTATCC |
| | | GGTAACTATCGTCTTGAGTCCAACC |
| | | CGGTAAGACACGACTTATCGCCACT |
| | | GGCAGCAGCCACTGGTAACAGGATT |
| | | AGCAGAGCGAGGTATGTAGGCGGTG |
| | | CTACAGAGTTCTTGAAGTGGTGGCC |
| | | TAACTACGGCTACACTAGAAGAACA |
| | | GTATTTGGTATCTGCGCTCTGCTGA |
| | | AGCCAGTTACCTTCGGAAAAAGAGT |
| | | TGGTAGCTCTTGATCCGGCAAACAA |
| | | ACCACCGCTGGTAGCGGTGGTTTTT |
| | | TTGTTTGCAAGCAGCAGATTACGCG |
| | | CAGAAAAAAAGGATCTCAAGAAGAT |
| | | CCTTTGATCTTTTCTACGGGGTCTG |
| | | ACGCTCAGTGGAACGAAAACTCACG |
| | | TTAAGGGATTTTGGTCATGAGATTA |
| | | TCAAAAAGGATCTTCACCTAGATCC |
| | | TTTTAAATTAAAAATGAAGTTTTAA |
| | | ATCAATCTAAAGTATATATGAGTAA |
| | | ACTTGGTCTGACAGTTACCAATGCT |
| | | TAATCAGTGAGGCACCTATCTCAGC |
| | | GATCTGTCTATTTCGTTCATCCATA |
| | | GTTGCCTGACTCCCCGTCGTGTAGA |
| | | TAACTACGATACGGGAGGGCTTACC |
| | | ATCTGGCCCCAGTGCTGCAATGATA |
| | | CCGCGAGACCCACGCTCACCGGCTC |
| | | CAGATTTATCAGCAATAAACCAGCC |
| | | AGCCGGAAGGGCCGAGCGCAGAAGT |
| | | GGTCCTGCAACTTTATCCGCCTCCA |
| | | TCCAGTCTATTAATTGTTGCCGGGA |
| | | AGCTAGAGTAAGTAGTTCGCCAGTT |
| | | AATAGTTTGCGCAACGTTGTTGCCA |
| | | TTGCTACAGGCATCGTGGTGTCACG |
| | | CTCGTCGTTTGGTATGGCTTCATTC |
| | | AGCTCCGGTTCCCAACGATCAAGGC |
| | | GAGTTACATGATCCCCCATGTTGTG |
| | | CAAAAAAGCGGTTAGCTCCTTCGGT |
| | | CCTCCGATCGTTGTCAGAAGTAAGT |
| | | TGGCCGCAGTGTTATCACTCATGGT |
| | | TATGGCAGCACTGCATAATTCTCTT |
| | | ACTGTCATGCCATCCGTAAGATGCT |
| | | TTTCTGTGACTGGTGAGTACTCAAC |
| | | CAAGTCATTCTGAGAATAGTGTATG |
| | | CGGCGACCGAGTTGCTCTTGCCCGG |
| | | CGTCAATACGGGATAATACCGCGCC |
| | | ACATAGCAGAACTTTAAAAGTGCTC |
| | | ATCATTGGAAAACGTTCTTCGGGGC |
| | | GAAAACTCTCAAGGATCTTACCGCT |
| | | GTTGAGATCCAGTTCGATGTAACCC |
| | | ACTCGTGCACCCAACTGATCTTCAG |
| | | CATCTTTTACTTTCACCAGCGTTTC |
| | | TGGGTGAGCAAAAACAGGAAGGCAA |
| | | AATGCCGCAAAAAAGGGAATAAGGG |
| | | CGACACGGAAATGTTGAATACTCAT |
| | | ACTCTTCCTTTTTCAATATTATTGA |
| | | AGCATTTATCAGGGTTATTGTCTCA |
| | | TGAGCGGATACATATTTGAATGTAT |
| | | TTAGAAAAATAAACAAATAGGGGTT |
| | | CCGCGCACATTTCCCCGAAAAGTGC |
| | | CACCT |
| 180 | JL42_pFYF_ gRNA_ABE_ site_13 | GACGTCGCTAGCTGTACAAAAAAGC AGGCTTTAAAGGAACCAATTCAGTC GACTGGATCCGGTACCAAGGTCGGG CAGGAAGAGGGCCTATTTCCCATGA TTCCTTCATATTTGCATATACGATA |

-continued

| SEQ ID NO: | Vector | Sequence |
|---|---|---|
| | | CAAGGCTGTTAGAGAGATAATTAGA |
| | | ATTAATTTGACTGTAAACACAAAGA |
| | | TATTAGTACAAAATACGTGACGTAG |
| | | AAAGTAATAATTTCTTGGGTAGTTT |
| | | GCAGTTTTAAAATTATGTTTTAAAA |
| | | TGGACTATCATATGCTTACCGTAAC |
| | | TTGAAAGTATTTCGATTTCTTGGCT |
| | | TTATATATCTTGTGGAAAGGACGAA |
| | | ACACCGGAAGATAGAGAATAGACTG |
| | | CGTTTTAGAGCTAGAAATAGCAAGT |
| | | TAAAATAAGGCTAGTCCGTTATCAA |
| | | CTTGAAAAAGTGGCACCGAGTCGGT |
| | | GCTTTTTTTAAGCTTGGGCCGCTCG |
| | | AGGTACCTCTCTACATATGACATGT |
| | | GAGCAAAAGGCCAGCAAAAGGCCAG |
| | | GAACCGTAAAAAGGCCGCGTTGCTG |
| | | GCGTTTTTCCATAGGCTCCGCCCCC |
| | | CTGACGAGCATCACAAAAATCGACG |
| | | CTCAAGTCAGAGGTGGCGAAACCCG |
| | | ACAGGACTATAAAGATACCAGGCGT |
| | | TTCCCCCTGGAAGCTCCCTCGTGCG |
| | | CTCTCCTGTTCCGACCCTGCCGCTT |
| | | ACCGGATACCTGTCCGCCTTTCTCC |
| | | CTTCGGGAAGCGTGGCGCTTTCTCA |
| | | TAGCTCACGCTGTAGGTATCTCAGT |
| | | TCGGTGTAGGTCGTTCGCTCCAAGC |
| | | TGGGCTGTGTGCACGAACCCCCCGT |
| | | TCAGCCCGACCGCTGCGCCTTATCC |
| | | GGTAACTATCGTCTTGAGTCCAACC |
| | | CGGTAAGACACGACTTATCGCCACT |
| | | GGCAGCAGCCACTGGTAACAGGATT |
| | | AGCAGAGCGAGGTATGTAGGCGGTG |
| | | CTACAGAGTTCTTGAAGTGGTGGCC |
| | | TAACTACGGCTACACTAGAAGAACA |
| | | GTATTTGGTATCTGCGCTCTGCTGA |
| | | AGCCAGTTACCTTCGGAAAAAGAGT |
| | | TGGTAGCTCTTGATCCGGCAAACAA |
| | | ACCACCGCTGGTAGCGGTGGTTTTT |
| | | TTGTTTGCAAGCAGCAGATTACGCG |
| | | CAGAAAAAAAGGATCTCAAGAAGAT |
| | | CCTTTGATCTTTTCTACGGGGTCTG |
| | | ACGCTCAGTGGAACGAAAACTCACG |
| | | TTAAGGGATTTTGGTCATGAGATTA |
| | | TCAAAAAGGATCTTCACCTAGATCC |
| | | TTTTAAATTAAAAATGAAGTTTTAA |
| | | ATCAATCTAAAGTATATATGAGTAA |
| | | ACTTGGTCTGACAGTTACCAATGCT |
| | | TAATCAGTGAGGCACCTATCTCAGC |
| | | GATCTGTCTATTTCGTTCATCCATA |
| | | GTTGCCTGACTCCCCGTCGTGTAGA |
| | | TAACTACGATACGGGAGGGCTTACC |
| | | ATCTGGCCCCAGTGCTGCAATGATA |
| | | CCGCGAGACCCACGCTCACCGGCTC |
| | | CAGATTTATCAGCAATAAACCAGCC |
| | | AGCCGGAAGGGCCGAGCGCAGAAGT |
| | | GGTCCTGCAACTTTATCCGCCTCCA |
| | | TCCAGTCTATTAATTGTTGCCGGGA |
| | | AGCTAGAGTAAGTAGTTCGCCAGTT |
| | | AATAGTTTGCGCAACGTTGTTGCCA |
| | | TTGCTACAGGCATCGTGGTGTCACG |
| | | CTCGTCGTTTGGTATGGCTTCATTC |
| | | AGCTCCGGTTCCCAACGATCAAGGC |
| | | GAGTTACATGATCCCCCATGTTGTG |
| | | CAAAAAAGCGGTTAGCTCCTTCGGT |
| | | CCTCCGATCGTTGTCAGAAGTAAGT |
| | | TGGCCGCAGTGTTATCACTCATGGT |
| | | TATGGCAGCACTGCATAATTCTCTT |
| | | ACTGTCATGCCATCCGTAAGATGCT |
| | | TTTCTGTGACTGGTGAGTACTCAAC |
| | | CAAGTCATTCTGAGAATAGTGTATG |
| | | CGGCGACCGAGTTGCTCTTGCCCGG |
| | | CGTCAATACGGGATAATACCGCGCC |
| | | ACATAGCAGAACTTTAAAAGTGCTC |
| | | ATCATTGGAAAACGTTCTTCGGGGC |
| | | GAAAACTCTCAAGGATCTTACCGCT |

-continued

| SEQ ID NO: | Vector | Sequence |
|---|---|---|
| | | GTTGAGATCCAGTTCGATGTAACCC |
| | | ACTCGTGCACCCAACTGATCTTCAG |
| | | CATCTTTTACTTTCACCAGCGTTTC |
| | | TGGGTGAGCAAAAACAGGAAGGCAA |
| | | AATGCCGCAAAAAAGGGAATAAGGG |
| | | CGACACGGAAATGTTGAATACTCAT |
| | | ACTCTTCCTTTTTCAATATTATTGA |
| | | AGCATTTATCAGGGTTATTGTCTCA |
| | | TGAGCGGATACATATTTGAATGTAT |
| | | TTAGAAAAATAAACAAATAGGGGTT |
| | | CCGCGCACATTTCCCCGAAAAGTGC |
| | | CACCT |
| 181 | JL42_pFYF_ gRNA_ABE_ site_16 | GACGTCGCTAGCTGTACAAAAAAGC |
| | | AGGCTTTAAAGGAACCAATTCAGTC |
| | | GACTGGATCCGGTACCAAGGTCGGG |
| | | CAGGAAGAGGGCCTATTTCCCATGA |
| | | TTCCTTCATATTTGCATATACGATA |
| | | CAAGGCTGTTAGAGAGATAATTAGA |
| | | ATTAATTTGACTGTAAACACAAAGA |
| | | TATTAGTACAAAATACGTGACGTAG |
| | | AAAGTAATAATTTCTTGGGTAGTTT |
| | | GCAGTTTTAAAATTATGTTTTAAAA |
| | | TGGACTATCATATGCTTACCGTAAC |
| | | TTGAAAGTATTTCGATTTCTTGGCT |
| | | TTATATATCTTGTGGAAAGGACGAA |
| | | ACACCGGGAATAAATCATAGAATC |
| | | CGTTTTAGAGCTAGAAATAGCAAGT |
| | | TAAAATAAGGCTAGTCCGTTATCAA |
| | | CTTGAAAAAGTGGCACCGAGTCGGT |
| | | GCTTTTTTTAAGCTTGGGCCGCTCG |
| | | AGGTACCTCTCTACATATGACATGT |
| | | GAGCAAAAGGCCAGCAAAAGGCCAG |
| | | GAACCGTAAAAAGGCCGCGTTGCTG |
| | | GCGTTTTTCCATAGGCTCCGCCCCC |
| | | CTGACGAGCATCACAAAAATCGACG |
| | | CTCAAGTCAGAGGTGGCGAAACCCG |
| | | ACAGGACTATAAAGATACCAGGCGT |
| | | TTCCCCCTGGAAGCTCCCTCGTGCG |
| | | CTCTCCTGTTCCGACCCTGCCGCTT |
| | | ACCGGATACCTGTCCGCCTTTCTCC |
| | | CTTCGGGAAGCGTGGCGCTTTCTCA |
| | | TAGCTCACGCTGTAGGTATCTCAGT |
| | | TCGGTGTAGGTCGTTCGCTCCAAGC |
| | | TGGGCTGTGTGCACGAACCCCCCGT |
| | | TCAGCCCGACCGCTGCGCCTTATCC |
| | | GGTAACTATCGTCTTGAGTCCAACC |
| | | CGGTAAGACACGACTTATCGCCACT |
| | | GGCAGCAGCCACTGGTAACAGGATT |
| | | AGCAGAGCGAGGTATGTAGGCGGTG |
| | | CTACAGAGTTCTTGAAGTGGTGGCC |
| | | TAACTACGGCTACACTAGAAGAACA |
| | | GTATTTGGTATCTGCGCTCTGCTGA |
| | | AGCCAGTTACCTTCGGAAAAAGAGT |
| | | TGGTAGCTCTTGATCCGGCAAACAA |
| | | ACCACCGCTGGTAGCGGTGGTTTTT |
| | | TTGTTTGCAAGCAGCAGATTACGCG |
| | | CAGAAAAAAAGGATCTCAAGAAGAT |
| | | CCTTTGATCTTTTCTACGGGGTCTG |
| | | ACGCTCAGTGGAACGAAAACTCACG |
| | | TTAAGGGATTTTGGTCATGAGATTA |
| | | TCAAAAAGGATCTTCACCTAGATCC |
| | | TTTTAAATTAAAAATGAAGTTTTAA |
| | | ATCAATCTAAAGTATATATGAGTAA |
| | | ACTTGGTCTGACAGTTACCAATGCT |
| | | TAATCAGTGAGGCACCTATCTCAGC |
| | | GATCTGTCTATTTCGTTCATCCATA |
| | | GTTGCCTGACTCCCCGTCGTGTAGA |
| | | TAACTACGATACGGGAGGGCTTACC |
| | | ATCTGGCCCCAGTGCTGCAATGATA |
| | | CCGCGAGACCCACGCTCACCGGCTC |
| | | CAGATTTATCAGCAATAAACCAGCC |
| | | AGCCGGAAGGGCCGAGCGCAGAAGT |
| | | GGTCCTGCAACTTTATCCGCCTCCA |
| | | TCCAGTCTATTAATTGTTGCCGGGA |

-continued

| SEQ ID NO: | Vector | Sequence |
|---|---|---|
| | | AGCTAGAGTAAGTAGTTCGCCAGTT |
| | | AATAGTTTGCGCAACGTTGTTGCCA |
| | | TTGCTACAGGCATCGTGGTGTCACG |
| | | CTCGTCGTTTGGTATGGCTTCATTC |
| | | AGCTCCGGTTCCCAACGATCAAGGC |
| | | GAGTTACATGATCCCCCATGTTGTG |
| | | CAAAAAAGCGGTTAGCTCCTTCGGT |
| | | CCTCCGATCGTTGTCAGAAGTAAGT |
| | | TGGCCGCAGTGTTATCACTCATGGT |
| | | TATGGCAGCACTGCATAATTCTCTT |
| | | ACTGTCATGCCATCCGTAAGATGCT |
| | | TTTCTGTGACTGGTGAGTACTCAAC |
| | | CAAGTCATTCTGAGAATAGTGTATG |
| | | CGGCGACCGAGTTGCTCTTGCCCGG |
| | | CGTCAATACGGGATAATACCGCGCC |
| | | ACATAGCAGAACTTTAAAAGTGCTC |
| | | ATCATTGGAAAACGTTCTTCGGGGC |
| | | GAAAACTCTCAAGGATCTTACCGCT |
| | | GTTGAGATCCAGTTCGATGTAACCC |
| | | ACTCGTGCACCCAACTGATCTTCAG |
| | | CATCTTTTACTTTCACCAGCGTTTC |
| | | TGGGTGAGCAAAAACAGGAAGGCAA |
| | | AATGCCGCAAAAAAGGGAATAAGGG |
| | | CGACACGGAAATGTTGAATACTCAT |
| | | ACTCTTCCTTTTTCAATATTATTGA |
| | | AGCATTTATCAGGGTTATTGTCTCA |
| | | TGAGCGGATACATATTTGAATGTAT |
| | | TTAGAAAAATAAACAAATAGGGGTT |
| | | CCGCGCACATTTCCCCGAAAAGTGC |
| | | CACCT |
| 182 | JL42_pFYF_gRNA1 | GACGTCGCTAGCTGTACAAAAAAGC |
| | | AGGCTTTAAAGGAACCAATTCAGTC |
| | | GACTGGATCCGGTACCAAGGTCGGG |
| | | CAGGAAGAGGGCCTATTTCCCATGA |
| | | TTCCTTCATATTTGCATATACGATA |
| | | CAAGGCTGTTAGAGAGATAATTAGA |
| | | ATTAATTTGACTGTAAACACAAAGA |
| | | TATTAGTACAAAATACGTGACGTAG |
| | | AAAGTAATAATTTCTTGGGTAGTTT |
| | | GCAGTTTTAAAATTATGTTTTAAAA |
| | | TGGACTATCATATGCTTACCGTAAC |
| | | TTGAAAGTATTTCGATTTCTTGGCT |
| | | TTATATATCTTGTGGAAAGGACGAA |
| | | ACACCGTTCACCTCTCATTCAGATT |
| | | Tgtttttagagctagaaatagcaagt |
| | | taaaataaggctagtccgttatcaa |
| | | cttgaaaaagtggcaccgagtcggtg |
| | | cTTTTTTTAAGCTTGGGCCGCTCGAG |
| | | GTACCTCTCTACATATGACATGTGA |
| | | GCAAAAGGCCAGCAAAAGGCCAGGA |
| | | ACCGTAAAAAGGCCGCGTTGCTGGC |
| | | GTTTTTCCATAGGCTCCGCCCCCCT |
| | | GACGAGCATCACAAAAATCGACGCT |
| | | CAAGTCAGAGGTGGCGAAACCCGAC |
| | | AGGACTATAAAGATACCAGGCGTTT |
| | | CCCCCTGGAAGCTCCCTCGTGCGCT |
| | | CTCCTGTTCCGACCCTGCCGCTTAC |
| | | CGGATACCTGTCCGCCTTTCTCCCT |
| | | TCGGGAAGCGTGGCGCTTTCTCATA |
| | | GCTCACGCTGTAGGTATCTCAGTTC |
| | | GGTGTAGGTCGTTCGCTCCAAGCTG |
| | | GGCTGTGTGCACGAACCCCCCGTTC |
| | | AGCCCGACCGCTGCGCCTTATCCGG |
| | | TAACTATCGTCTTGAGTCCAACCCG |
| | | GTAAGACACGACTTATCGCCACTGG |
| | | CAGCAGCCACTGGTAACAGGATTAG |
| | | CAGAGCGAGGTATGTAGGCGGTGCT |
| | | ACAGAGTTCTTGAAGTGGTGGCCTA |
| | | ACTACGGCTACACTAGAAGAACAGT |
| | | ATTTGGTATCTGCGCTCTGCTGAAG |
| | | CCAGTTACCTTCGGAAAAAGAGTTG |
| | | GTAGCTCTTGATCCGGCAAACAAAC |
| | | CACCGCTGGTAGCGGTGGTTTTTTT |
| | | GTTTGCAAGCAGCAGATTACGCGCA |

-continued

| SEQ ID NO: | Vector | Sequence |
|---|---|---|
| | | GAAAAAAAGGATCTCAAGAAGATCC |
| | | TTTGATCTTTTCTACGGGGTCTGAC |
| | | GCTCAGTGGAACGAAAACTCACGTT |
| | | AAGGGATTTTGGTCATGAGATTATC |
| | | AAAAAGGATCTTCACCTAGATCCTT |
| | | TTAAATTAAAAATGAAGTTTTAAAT |
| | | CAATCTAAAGTATATATGAGTAAAC |
| | | TTGGTCTGACAGTTACCAATGCTTA |
| | | ATCAGTGAGGCACCTATCTCAGCGA |
| | | TCTGTCTATTTCGTTCATCCATAGT |
| | | TGCCTGACTCCCCGTCGTGTAGATA |
| | | ACTACGATACGGGAGGGCTTACCAT |
| | | CTGGCCCCAGTGCTGCAATGATACC |
| | | GCGAGACCCACGCTCACCGGCTCCA |
| | | GATTTATCAGCAATAAACCAGCCAG |
| | | CCGGAAGGGCCGAGCGCAGAAGTGG |
| | | TCCTGCAACTTTATCCGCCTCCATC |
| | | CAGTCTATTAATTGTTGCCGGGAAG |
| | | CTAGAGTAAGTAGTTCGCCAGTTAA |
| | | TAGTTTGCGCAACGTTGTTGCCATT |
| | | GCTACAGGCATCGTGGTGTCACGCT |
| | | CGTCGTTTGGTATGGCTTCATTCAG |
| | | CTCCGGTTCCCAACGATCAAGGCGA |
| | | GTTACATGATCCCCATGTTGTGCA |
| | | AAAAAGCGGTTAGCTCCTTCGGTCC |
| | | TCCGATCGTTGTCAGAAGTAAGTTG |
| | | GCCGCAGTGTTATCACTCATGGTTA |
| | | TGGCAGCACTGCATAATTCTCTTAC |
| | | TGTCATGCCATCCGTAAGATGCTTT |
| | | TCTGTGACTGGTGAGTACTCAACCA |
| | | AGTCATTCTGAGAATAGTGTATGCG |
| | | GCGACCGAGTTGCTCTTGCCCGGCG |
| | | TCAATACGGGATAATACCGCGCCAC |
| | | ATAGCAGAACTTTAAAAGTGCTCAT |
| | | CATTGGAAAACGTTCTTCGGGGCGA |
| | | AAACTCTCAAGGATCTTACCGCTGT |
| | | TGAGATCCAGTTCGATGTAACCCAC |
| | | TCGTGCACCCAACTGATCTTCAGCA |
| | | TCTTTTACTTTCACCAGCGTTTCTG |
| | | GGTGAGCAAAAACAGGAAGGCAAAA |
| | | TGCCGCAAAAAAGGGAATAAGGGCG |
| | | ACACGGAAATGTTGAATACTCATAC |
| | | TCTTCCTTTTTCAATATTATTGAAG |
| | | CATTTATCAGGGTTATTGTCTCATG |
| | | AGCGGATACATATTTGAATGTATTT |
| | | AGAAAAATAAACAAATAGGGGTTCC |
| | | GCGCACATTTCCCCGAAAAGTGCCA |
| | | CCT |
| 183 | JL42_pFYF_gRNA2 | GACGTCGCTAGCTGTACAAAAAAGC |
| | | AGGCTTTAAAGGAACCAATTCAGTC |
| | | GACTGGATCCGGTACCAAGGTCGGG |
| | | CAGGAAGAGGGCCTATTTCCCATGA |
| | | TTCCTTCATATTTGCATATACGATA |
| | | CAAGGCTGTTAGAGAGATAATTAGA |
| | | ATTAATTTGACTGTAAACACAAAGA |
| | | TATTAGTACAAAATACGTGACGTAG |
| | | AAAGTAATAATTTCTTGGGTAGTTT |
| | | GCAGTTTTAAAATTATGTTTTAAAA |
| | | TGGACTATCATATGCTTACCGTAAC |
| | | TTGAAAGTATTTCGATTTCTTGGCT |
| | | TTATATATCTTGTGGAAAGGACGAA |
| | | ACACCGTCACCTCTCATTCAGATTT |
| | | TGTTTTAGAGCTAGAAATAGCAAGT |
| | | TAAAATAAGGCTAGTCCGTTATCAA |
| | | CTTGAAAAAGTGGCACCGAGTCGGT |
| | | GCTTTTTTTAAGCTTGGGCCGCTCG |
| | | AGGTACCTCTCTACATATGACATGT |
| | | GAGCAAAAGGCCAGCAAAAGGCCAG |
| | | GAACCGTAAAAAGGCCGCGTTGCTG |
| | | GCGTTTTTCCATAGGCTCCGCCCCC |
| | | CTGACGAGCATCACAAAAATCGACG |
| | | CTCAAGTCAGAGGTGGCGAAACCCG |
| | | ACAGGACTATAAAGATACCAGGCGT |
| | | TTCCCCCTGGAAGCTCCCTCGTGCG |

307

-continued

| SEQ ID NO: | Vector | Sequence |
|---|---|---|
| | | CTCTCCTGTTCCGACCCTGCCGCTT |
| | | ACCGGATACCTGTCCGCCTTTCTCC |
| | | CTTCGGGAAGCGTGGCGCTTTCTCA |
| | | TAGCTCACGCTGTAGGTATCTCAGT |
| | | TCGGTGTAGGTCGTTCGCTCCAAGC |
| | | TGGGCTGTGTGCACGAACCCCCCGT |
| | | TCAGCCCGACCGCTGCGCCTTATCC |
| | | GGTAACTATCGTCTTGAGTCCAACC |
| | | CGGTAAGACACGACTTATCGCCACT |
| | | GGCAGCAGCCACTGGTAACAGGATT |
| | | AGCAGAGCGAGGTATGTAGGCGGTG |
| | | CTACAGAGTTCTTGAAGTGGTGGCC |
| | | TAACTACGGCTACACTAGAAGAACA |
| | | GTATTTGGTATCTGCGCTCTGCTGA |
| | | AGCCAGTTACCTTCGGAAAAAGAGT |
| | | TGGTAGCTCTTGATCCGGCAAACAA |
| | | ACCACCGCTGGTAGCGGTGGTTTTT |
| | | TTGTTTGCAAGCAGCAGATTACGCG |
| | | CAGAAAAAAAGGATCTCAAGAAGAT |
| | | CCTTTGATCTTTTCTACGGGGTCTG |
| | | ACGCTCAGTGGAACGAAAACTCACG |
| | | TTAAGGGATTTTGGTCATGAGATTA |
| | | TCAAAAAGGATCTTCACCTAGATCC |
| | | TTTTAAATTAAAAATGAAGTTTTAA |
| | | ATCAATCTAAAGTATATATGAGTAA |
| | | ACTTGGTCTGACAGTTACCAATGCT |
| | | TAATCAGTGAGGCACCTATCTCAGC |
| | | GATCTGTCTATTTCGTTCATCCATA |
| | | GTTGCCTGACTCCCCGTCGTGTAGA |
| | | TAACTACGATACGGGAGGGCTTACC |
| | | ATCTGGCCCCAGTGCTGCAATGATA |
| | | CCGCGAGACCCACGCTCACCGGCTC |
| | | CAGATTTATCAGCAATAAACCAGCC |
| | | AGCCGGAAGGGCCGAGCGCAGAAGT |
| | | GGTCCTGCAACTTTATCCGCCTCCA |
| | | TCCAGTCTATTAATTGTTGCCGGGA |
| | | AGCTAGAGTAAGTAGTTCGCCAGTT |
| | | AATAGTTTGCGCAACGTTGTTGCCA |
| | | TTGCTACAGGCATCGTGGTGTCACG |
| | | CTCGTCGTTTGGTATGGCTTCATTC |
| | | AGCTCCGGTTCCCAACGATCAAGGC |
| | | GAGTTACATGATCCCCCATGTTGTG |
| | | CAAAAAAGCGGTTAGCTCCTTCGGT |
| | | CCTCCGATCGTTGTCAGAAGTAAGT |
| | | TGGCCGCAGTGTTATCACTCATGGT |
| | | TATGGCAGCACTGCATAATTCTCTT |
| | | ACTGTCATGCCATCCGTAAGATGCT |
| | | TTTCTGTGACTGGTGAGTACTCAAC |
| | | CAAGTCATTCTGAGAATAGTGTATG |
| | | CGGCGACCGAGTTGCTCTTGCCCGG |
| | | CGTCAATACGGGATAATACCGCGCC |
| | | ACATAGCAGAACTTTAAAAGTGCTC |
| | | ATCATTGGAAAACGTTCTTCGGGGC |
| | | GAAAACTCTCAAGGATCTTACCGCT |
| | | GTTGAGATCCAGTTCGATGTAACCC |
| | | ACTCGTGCACCCAACTGATCTTCAG |
| | | CATCTTTTACTTTCACCAGCGTTTC |
| | | TGGGTGAGCAAAAACAGGAAGGCAA |
| | | AATGCCGCAAAAAAGGGAATAAGGG |
| | | CGACACGGAAATGTTGAATACTCAT |
| | | ACTCTTCCTTTTTCAATATTATTGA |
| | | AGCATTTATCAGGGTTATTGTCTCA |
| | | TGAGCGGATACATATTTGAATGTAT |
| | | TTAGAAAAATAAACAAATAGGGGTT |
| | | CCGCGCACATTTCCCCGAAAAGTGC |
| | | CACCT |
| 184 | JL42_pFYF_gRNA3 | GACGTCGCTAGCTGTACAAAAAAGC |
| | | AGGCTTTAAAGGAACCAATTCAGTC |
| | | GACTGGATCCGGTACCAAGGTCGGG |
| | | CAGGAAGAGGGCCTATTTCCCATGA |
| | | TTCCTTCATATTTGCATATACGATA |
| | | CAAGGCTGTTAGAGAGATAATTAGA |
| | | ATTAATTTGACTGTAAACACAAAGA |
| | | TATTAGTACAAAATACGTGACGTAG |

308

-continued

| SEQ ID NO: | Vector | Sequence |
|---|---|---|
| | | AAAGTAATAATTTCTTGGGTAGTTT |
| | | GCAGTTTTAAAATTATGTTTTAAAA |
| | | TGGACTATCATATGCTTACCGTAAC |
| | | TTGAAAGTATTTCGATTTCTTGGCT |
| | | TTATATATCTTGTGGAAAGGACGAA |
| | | ACACCGTGGTGGTTCACCTCTCATT |
| | | CGTTTTAGAGCTAGAAATAGCAAGT |
| | | TAAAATAAGGCTAGTCCGTTATCAA |
| | | CTTGAAAAAGTGGCACCGAGTCGGT |
| | | GCTTTTTTTAAGCTTGGGCCGCTCG |
| | | AGGTACCTCTCTACATATGACATGT |
| | | GAGCAAAAGGCCAGCAAAAGGCCAG |
| | | GAACCGTAAAAAGGCCGCGTTGCTG |
| | | GCGTTTTTCCATAGGCTCCGCCCCC |
| | | CTGACGAGCATCACAAAAATCGACG |
| | | CTCAAGTCAGAGGTGGCGAAACCCG |
| | | ACAGGACTATAAAGATACCAGGCGT |
| | | TTCCCCCTGGAAGCTCCCTCGTGCG |
| | | CTCTCCTGTTCCGACCCTGCCGCTT |
| | | ACCGGATACCTGTCCGCCTTTCTCC |
| | | CTTCGGGAAGCGTGGCGCTTTCTCA |
| | | TAGCTCACGCTGTAGGTATCTCAGT |
| | | TCGGTGTAGGTCGTTCGCTCCAAGC |
| | | TGGGCTGTGTGCACGAACCCCCCGT |
| | | TCAGCCCGACCGCTGCGCCTTATCC |
| | | GGTAACTATCGTCTTGAGTCCAACC |
| | | CGGTAAGACACGACTTATCGCCACT |
| | | GGCAGCAGCCACTGGTAACAGGATT |
| | | AGCAGAGCGAGGTATGTAGGCGGTG |
| | | CTACAGAGTTCTTGAAGTGGTGGCC |
| | | TAACTACGGCTACACTAGAAGAACA |
| | | GTATTTGGTATCTGCGCTCTGCTGA |
| | | AGCCAGTTACCTTCGGAAAAAGAGT |
| | | TGGTAGCTCTTGATCCGGCAAACAA |
| | | ACCACCGCTGGTAGCGGTGGTTTTT |
| | | TTGTTTGCAAGCAGCAGATTACGCG |
| | | CAGAAAAAAAGGATCTCAAGAAGAT |
| | | CCTTTGATCTTTTCTACGGGGTCTG |
| | | ACGCTCAGTGGAACGAAAACTCACG |
| | | TTAAGGGATTTTGGTCATGAGATTA |
| | | TCAAAAAGGATCTTCACCTAGATCC |
| | | TTTTAAATTAAAAATGAAGTTTTAA |
| | | ATCAATCTAAAGTATATATGAGTAA |
| | | ACTTGGTCTGACAGTTACCAATGCT |
| | | TAATCAGTGAGGCACCTATCTCAGC |
| | | GATCTGTCTATTTCGTTCATCCATA |
| | | GTTGCCTGACTCCCCGTCGTGTAGA |
| | | TAACTACGATACGGGAGGGCTTACC |
| | | ATCTGGCCCCAGTGCTGCAATGATA |
| | | CCGCGAGACCCACGCTCACCGGCTC |
| | | CAGATTTATCAGCAATAAACCAGCC |
| | | AGCCGGAAGGGCCGAGCGCAGAAGT |
| | | GGTCCTGCAACTTTATCCGCCTCCA |
| | | TCCAGTCTATTAATTGTTGCCGGGA |
| | | AGCTAGAGTAAGTAGTTCGCCAGTT |
| | | AATAGTTTGCGCAACGTTGTTGCCA |
| | | TTGCTACAGGCATCGTGGTGTCACG |
| | | CTCGTCGTTTGGTATGGCTTCATTC |
| | | AGCTCCGGTTCCCAACGATCAAGGC |
| | | GAGTTACATGATCCCCCATGTTGTG |
| | | CAAAAAAGCGGTTAGCTCCTTCGGT |
| | | CCTCCGATCGTTGTCAGAAGTAAGT |
| | | TGGCCGCAGTGTTATCACTCATGGT |
| | | TATGGCAGCACTGCATAATTCTCTT |
| | | ACTGTCATGCCATCCGTAAGATGCT |
| | | TTTCTGTGACTGGTGAGTACTCAAC |
| | | CAAGTCATTCTGAGAATAGTGTATG |
| | | CGGCGACCGAGTTGCTCTTGCCCGG |
| | | CGTCAATACGGGATAATACCGCGCC |
| | | ACATAGCAGAACTTTAAAAGTGCTC |
| | | ATCATTGGAAAACGTTCTTCGGGGC |
| | | GAAAACTCTCAAGGATCTTACCGCT |
| | | GTTGAGATCCAGTTCGATGTAACCC |
| | | ACTCGTGCACCCAACTGATCTTCAG |
| | | CATCTTTTACTTTCACCAGCGTTTC |

-continued

```
SEQ
ID
NO:    Vector      Sequence

TGGGTGAGCAAAAACAGGAAGGCAA
                   AATGCCGCAAAAAAGGGAATAAGGG
                   CGACACGGAAATGTTGAATACTCAT
                   ACTCTTCCTTTTTCAATATTATTGA
                   AGCATTTATCAGGGTTATTGTCTCA
                   TGAGCGGATACATATTTGAATGTAT
                   TTAGAAAAATAAACAAATAGGGGTT
                   CCGCGCACATTTCCCCGAAAAGTGC
                   CACCT
```

Figure 2B:
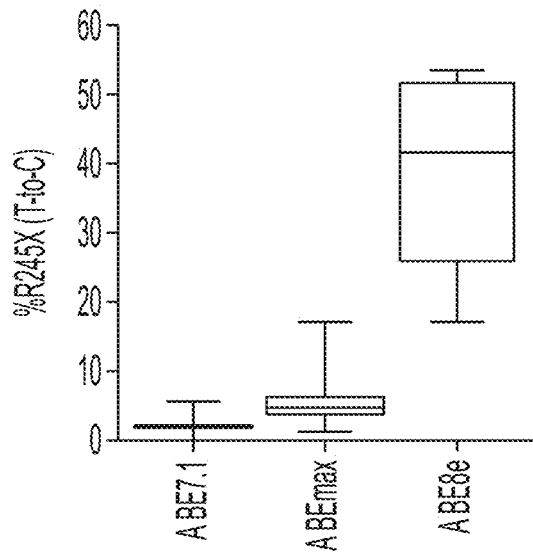

Amplification of R245X site was performed using PCR primer specific to lentivirus sequence. PCR products were sequenced using MISEQ® Illumina platform. Several days post transfection, transfected cells can be harvested and assayed for base editing. Correction of DNA is assessed with high throughput sequencing (HTS) of PCR products synthesized with cDNA-specific primers, and base editing efficiency is determined by the Python utility pysamstats. Elimination of the stop and normal translation of the exogenous cDNA is assessed with western blot for the FLAG and cMYC tags (FIG. 2B).

Figure 2C:
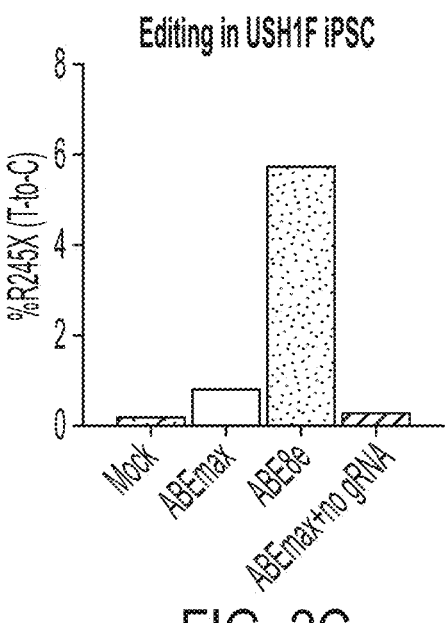

The in vitro assay with fibroblasts from an Usher 1F patient carrying homozygous R245X mutations are repeated. Base editors and gRNAs are transiently transfected into induced pluripotent stem cells (iPSC) derived from cells taken from an Usher1F patient harboring the PCDH15$^{R245X/}$ $_{R245X}$ locus. Transfection of iPSCs is inefficient (~10% cells transfected). Genomic DNA was harvested and the R245X locus amplified by PCR, sequenced via MISEQ® Illumina platform, and quantified using Python utility pysamstats. Again, successful base editing of genomic DNA is assayed with HTS of PCR products using primers within exon 8 (Ben-Yosef et al., 2003). Optimal gRNAs are confirmed on these human Usher 1F cells in vitro (FIG. 2C).

Figure 2D:
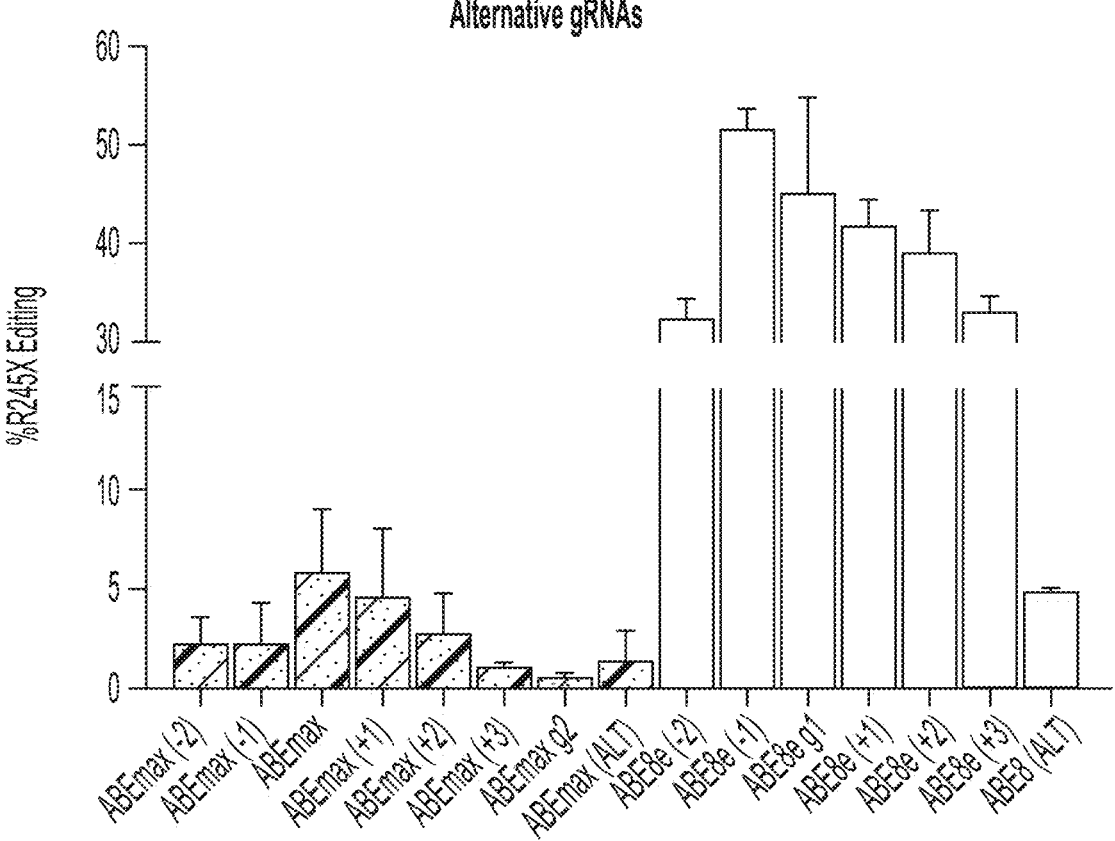

To determine editing efficiencies with guide varieties base editors ABEmax and ABE8e were transfected with gRNAs (vector sequences shown in Table 5, below) into HEK293T cells harboring the PCDH15 R245X mutation as in FIG. 2B. Results are shown in FIG. 2D. (#) refer to the variants of guide 1, displayed in Table 4. No significant differences are observed between the gRNA1 variants and gRNA1 except for (−2) and gRNA 1.

Figure 2E:
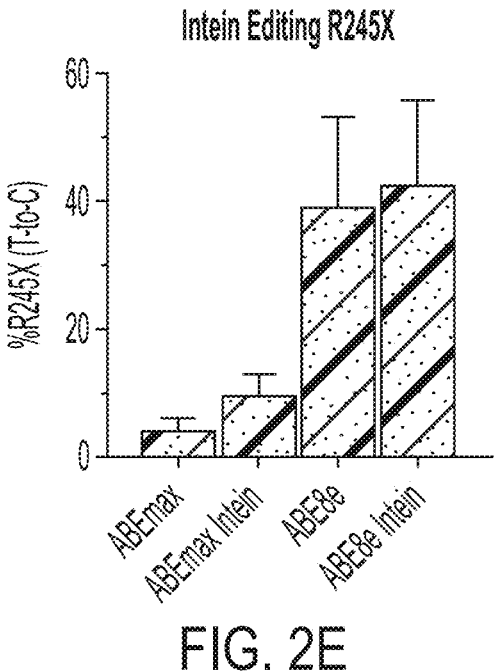

Base editing at R245X site using split-intein base editors was performed. HEK293T cells harboring the R245X mutation were transfected with plasmids containing gRNA1 and split-intein versions of ABEmax and ABE8e. Split-intein plasmids consist of: the ABE fused to the N-terminal Cas9 followed by an Nterminal Npu Intein sequence; and the C-term Npu intein sequence followed by the C-terminal Cas9 and U6promoter gRNA. QED Split-intein tests co-transfected two plasmids simultaneously, the C-terminal plasmid used for both N-term ABEmax and N-term ABE8e split-intein plasmid. Editing between ABE8e and ABE8e split-intein are not significantly different, whereas both are significantly better at editing than ABEmax (FIG. 2E).

Figure 2F:
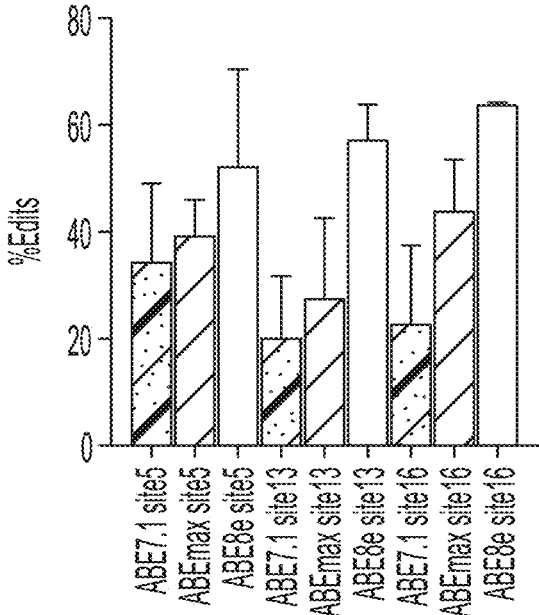

Editing of genomic loci with intein editors was performed. FIG. 2F shows editing efficiencies of ABE7.1, max, and 8e at several previously validated genomic sites [Site 5 (GRCh38.p12 c20. 32752960-32752979); Site 13 (GRCh38.p13 c20.20116785-20116804); Site 16 (GRCh38.p12 c01.179826686-179826705)]. HEK293T cells were transfected with gRNAs to genomic targets and base editors in equal concentrations. Genomic DNA was harvested and subjected to PCR and MISEQ® Illumina sequencing.

Any effort to bring PCDH15 R245X gene therapy to the clinic will first require demonstration of rescue in a suitable mouse model. But base editors and gRNAs headed to the clinic should recognize the human mutant DNA. A "humanized" mouse model in which 60 bp of the mouse exon 9 replaced with the equivalent sequence from human exon 8, with the R245X mutation was generated. Mouse exon 9 is present in almost all mouse PCDH15 splice forms (Ahmed et al., 2006), suggesting that a stop codon here truncates all mouse PCDH15 splice forms and cause deafness. Cyagen is producing the mouse for delivery in April 2019. Hair cell pathology and deafness in the homozygous humanized R245X mouse is assessed for lack of PCDH15, bundle morphology, FM1-43 dye loading, single-cell physiology, and ABR.

To test the efficacy of ABEmax on mutant mouse DNA in vitro, a fibroblast cell line harboring the R245X mutation is created from humanized mouse. ABEmax is delivered to these cells by transfection in culture and test the efficacy of base editing.

For gene therapy, ABEmax and gRNAs have to be delivered to affected cells in a viral vector. AAV vectors (AAV9-PHP.B or better variants developed by Core C) are used for efficient targeting to OHCs, but ABEmax coding sequence does not fit in AAV.

Other Embodiments

All of the features disclosed in this specification may be combined in any combination. Each feature disclosed in this specification may be replaced by an alternative feature serving the same, equivalent, or similar purpose. Thus, unless expressly stated otherwise, each feature disclosed is only an example of a generic series of equivalent or similar features.

From the above description, one skilled in the art can easily ascertain the essential characteristics of the present invention, and without departing from the spirit and scope thereof, can make various changes and modifications of the invention to adapt it to various usages and conditions. Thus, other embodiments are also within the claims.

EQUIVALENTS

While several inventive embodiments have been described and illustrated herein, those of ordinary skill in the art will readily envision a variety of other means and/or structures for performing the function and/or obtaining the results and/or one or more of the advantages described herein, and each of such variations and/or modifications is deemed to be within the scope of the inventive embodiments described herein. More generally, those skilled in the art will readily appreciate that all parameters, dimensions, materials, and configurations described herein are meant to be exemplary and that the actual parameters, dimensions, materials, and/or configurations will depend upon the specific application or applications for which the inventive teachings is/are used. Those skilled in the art will recognize, or be able to ascertain using no more than routine experimentation, many equivalents to the specific inventive embodiments described herein. It is, therefore, to be understood that the foregoing embodiments are presented by way of example only and that, within the scope of the appended claims and equivalents thereto, inventive embodiments may be practiced otherwise than as specifically described and claimed. Inventive embodiments of the present disclosure are directed to each individual feature, system, article, material, kit, and/or method described herein. In addition, any combination of two or more such features, systems, articles, materials, kits, and/or methods, if such features, systems, articles, materials, kits, and/or methods are not mutually inconsistent, is included within the inventive scope of the present disclosure.

All definitions, as defined and used herein, should be understood to control over dictionary definitions, definitions in documents incorporated by reference, and/or ordinary meanings of the defined terms.

All references, patents and patent applications disclosed herein are incorporated by reference with respect to the subject matter for which each is cited, which in some cases may encompass the entirety of the document.

The indefinite articles "a" and "an," as used herein in the specification and in the claims, unless clearly indicated to the contrary, should be understood to mean "at least one."

The phrase "and/or," as used herein in the specification and in the claims, should be understood to mean "either or both" of the elements so conjoined, i.e., elements that are conjunctively present in some cases and disjunctively present in other cases. Multiple elements listed with "and/or" should be construed in the same fashion, i.e., "one or more" of the elements so conjoined. Other elements may optionally be present other than the elements specifically identified by the "and/or" clause, whether related or unrelated to those elements specifically identified. Thus, as a non-limiting example, a reference to "A and/or B", when used in conjunction with open-ended language such as "comprising" can refer, in one embodiment, to A only (optionally including elements other than B); in another embodiment, to B only (optionally including elements other than A); in yet another embodiment, to both A and B (optionally including other elements); etc.

As used herein in the specification and in the claims, "or" should be understood to have the same meaning as "and/or" as defined above. For example, when separating items in a list, "or" or "and/or" shall be interpreted as being inclusive, i.e., the inclusion of at least one, but also including more than one, of a number or list of elements, and, optionally, additional unlisted items. Only terms clearly indicated to the contrary, such as "only one of" or "exactly one of," or, when used in the claims, "consisting of," will refer to the inclusion of exactly one element of a number or list of elements. In general, the term "or" as used herein shall only be interpreted as indicating exclusive alternatives (i.e. "one or the other but not both") when preceded by terms of exclusivity, such as "either," "one of," "only one of," or "exactly one of." "Consisting essentially of," when used in the claims, shall have its ordinary meaning as used in the field of patent law.

As used herein in the specification and in the claims, the phrase "at least one," in reference to a list of one or more elements, should be understood to mean at least one element selected from any one or more of the elements in the list of elements, but not necessarily including at least one of each and every element specifically listed within the list of elements and not excluding any combinations of elements in the list of elements. This definition also allows that elements may optionally be present other than the elements specifically identified within the list of elements to which the phrase "at least one" refers, whether related or unrelated to those elements specifically identified. Thus, as a non-limiting example, "at least one of A and B" (or, equivalently, "at least one of A or B," or, equivalently "at least one of A and/or B") can refer, in one embodiment, to at least one, optionally including more than one, A, with no B present (and optionally including elements other than B); in another embodiment, to at least one, optionally including more than one, B, with no A present (and optionally including elements other than A); in yet another embodiment, to at least one, optionally including more than one, A, and at least one, optionally including more than one, B (and optionally including other elements); etc.

It should also be understood that, unless clearly indicated to the contrary, in any methods claimed herein that include more than one step or act, the order of the steps or acts of the method is not necessarily limited to the order in which the steps or acts of the method are recited.

SEQUENCE LISTING (190 sequences)

SEQ ID NO: 1 - protein, 1252 aa, Homo sapiens
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLD

SEQ ID NO: 2 - DNA, 3756 bp, Homo sapiens
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggat

SEQ ID NO: 3 - protein, 26 aa, Homo sapiens
MFRQFYLWTCLASGIILGSLFEICLG

SEQ ID NO: 4 - protein, 122 aa, Homo sapiens
QYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDN

SEQ ID NO: 5 - protein, 118 aa, Homo sapiens
SPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDL

SEQ ID NO: 6 - protein, 130 aa, Homo sapiens
GPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQ

SEQ ID NO: 7 - protein, 114 aa, Homo sapiens
SPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDN

SEQ ID NO: 8 - protein, 106 aa, Homo sapiens
TPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQ

SEQ ID NO: 9 - protein, 102 aa, Homo sapiens
SPPRFPQLMYSLEISEAMRVGAVLLNLQATDREGDSITYAIENGDPQRVFNLSETTGILTLGKALDRESTDRYILIITASDGRPDGTSTATVNIVVTDVNDN

SEQ ID NO: 10 - protein, 102 aa, Homo sapiens
APVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDN

SEQ ID NO: 11 - protein, 107 aa, Homo sapiens
SPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDY

SEQ ID NO: 12 - protein, 109 aa, Homo sapiens
PPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGE

SEQ ID NO: 13 - protein, 109 aa, Homo sapiens
IPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNH

SEQ ID NO: 14 - protein, 107 aa, Homo sapiens
PPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLD

SEQ ID NO: 15 - protein, 127 aa, Homo sapiens
MQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTE

SEQ ID NO: 16 - protein, 583 aa, Homo sapiens
GALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 17 - DNA, 78 bp, Homo sapiens
atgtttcgacagttttatctctggacatgtttagcttcagggatcatcctgggctctctctttgaaatctgcttgggc

SEQ ID NO: 18 - DNA, 366 bp, Homo sapiens
cagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaac

SEQ ID NO: 19 - DNA, 354 bp, Homo sapiens
tcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttg

SEQ ID NO: 20 - DNA, 390 bp, Homo sapiens
ggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaa

SEQ ID NO: 21 - DNA, 342 bp, Homo sapiens
agtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataac

SEQ ID NO: 22 - DNA, 318 bp, Homo sapiens
acgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaa

SEQ ID NO: 23 - DNA, 306 bp, Homo sapiens
agccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaat

SEQ ID NO: 24 - DNA, 306 bp, Homo sapiens
gctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataac

SEQ ID NO: 25 - DNA, 321 bp, Homo sapiens
agtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattat

SEQ ID NO: 26 - DNA, 327 bp, Homo sapiens
cctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgag

SEQ ID NO: 27 - DNA, 327 bp, Homo sapiens
atcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcat

SEQ ID NO: 28 - DNA, 321 bp, Homo sapiens
cccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggat

SEQ ID NO: 29 - DNA, 381 bp, Homo sapiens
atgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaa

SEQ ID NO: 30 - DNA, 1752 bp, Homo sapiens
ggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaa

SEQ ID NO: 31 - protein, 1639 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 32 - DNA, 4920 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaa

SEQ ID NO: 33 - protein, 1652 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 34 - DNA, 4959 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaa

SEQ ID NO: 35 - protein, 1538 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 36 - DNA, 4617 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaa

SEQ ID NO: 37 - protein, 1523 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 38 - DNA, 4572 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataaccccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaa

SEQ ID NO: 39 - protein, 1536 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 40 - DNA, 4611 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaa

SEQ ID NO: 41 - protein, 1431 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 42 - DNA, 4296 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaacctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaa

SEQ ID NO: 43 - protein, 1422 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 44 - DNA, 4269 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaagctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaa

SEQ ID NO: 45 - protein, 1429 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 46 - DNA, 4290 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataaccccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaa

SEQ ID NO: 47 - protein, 743 aa, Artificial Sequence
  Synthetic
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 48 - DNA, 2232 bp, Artificial Sequence
  Synthetic
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaagaactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaaactttggcggtgccttttaaggcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 49 - protein, 1367 aa, Artificial Sequence
  Synthetic
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 50 - protein, 1367 aa, Artificial Sequence
  Synthetic
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 51 - DNA, 20 bp, Artificial Sequence
  Synthetic
ttcacctctcattcagattt

SEQ ID NO: 52 - protein, 178 aa, Artificial Sequence
  Synthetic
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 53 - protein, 1962 aa, Homo sapiens
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 54 - DNA, 5889 bp, Homo sapiens
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaa

SEQ ID NO: 55 - protein, 1790 aa, Homo sapiens
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 56 - DNA, 5543 bp, Homo sapiens
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattttgatatgacttatgatcagaagcatgccagaaaagtgaatatatatgttgtccaaatccat

SEQ ID NO: 57 - protein, 1682 aa, Homo sapiens
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 58 - DNA, 8857 bp, Homo sapiens
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtgaccaattttttaaaagatattttaattaatttttacttacatttttaataaactgtgctttttattgtcactgagaaaacaatgtatggaatttatatcatgcacacaagctaaaactttgaacaatatgctttaaaattttaagagacagatttgcactcacattgttatcaattaatcgtttttcccagaaaatccttttggacatactttcactaaataacctatcgtttaaacatttagctgttttgttgggtcttgaatttttgttcattttaataaacaagaaataattactaaataatcatttatattttattgattaacatagattatgctttatttctagctccacaaaacatttttagtacatgtaattttattttccatagccaaaagggcaaaaaagaagtaagaggatatttacaggcaatgagtttatacagctgctgtctatactgccctaatttttaaaatgaaagctagaattgcaaagtaaagtaaatgagggaatcacctgtaaataattaattattttaaatcatgagcttgttttctttctttattgtcctgtataaaggttttcacattttaccataaatacatttatatcttgaccctttaggaaaccacttgaagtcgtatgtctttttatcaatattatttacaatattctcttgtcccttcatctcatatcaaatatggtagatactttagtttagtttaatcacttgaggttaaataattgtttggagcaacatggaaatctcacccttagcaaaagcttttagggaagtgagaaaggttcgagtaagcagtaatgcatctagaacgacaatttcataatggaagacatggtgaggttagggaagtctcacattaatgtcactagactttaatagtttgtaaacccagcatatcagagtaaaggaatttggcagggttgaaatgtatataatatataaagcttataaaggctatgaattcataacttcaaatgttgtgtttaacttcttccattttcaggttatttatagaatattttaatgcacatatttatgtgcctaaaatccagaaccaggaaatcattgcctgggcattttttaaaatcaaagaacatggtcttgattttttaccattgaacaaagcacagtgtttcatcataagtagaaatgaaaacagaatatcctttaaaaaacttgccttgtgtgttgcttattttccagatgatgtaaaaagaatgaaacaatatagattaagagaattcagaattctattgaatattacttagtatgatatagatgtagctcacttcaaattttgcacagtattgaccaagttcaggttttaatgaaatttcctcatgcatgcttaatatatggttgaaggactgaataatgcactattatttattcccctcttacatgtttcgcgtcttaaaaattgtttattattatgctatttcctcatttccaaagtgaatgaattgtactgacataaacttgccgacttgtaagagtagtatgtttttacttcagatttccaagaaaatatttgagatcaaatacagtaacatctcatctaccttattttattgagaattaatgcattccatacccttgccaaaaaaacaaaacaaaacaaacaaacaaaaaaaaacctagtggcattagctagattagaaacgtagaatcatgaccacacctcctggcctgccaaacaagcatccacattttcaaaagatcctaaggtggtttatatgcacattaaattttggaagcaatgaagtccggggcttattccttcaggcaccaaagcaatggtttttagtataggatactttgtataggaattagattaagcatatatttccctactaattcaatcagaggtcatcgaatataatttaatattatcttgatacccccagatcatctcagtcagcatcccttgatattctctctatatacagcttcatggctgcgtttttgtcctttgatttctggctgtgacatttaacttattctgttgttgtgcctttctcacatttttttctttcagtttatagcttctagtatcctgatgggaaagtttgtgttttttgtttgttttcttaatgttgaaaaatcatgaagcttaagatgggaattaggtacacggattcaaccaaatgttttgcgactcttagacgctttctttggttaccagtagatttggaaatatgatgttggcagaagtctagtggcctgacatatgagatgtcactgtattttaaactacattttttatgagaaaatatgcaaaattttacaagccacttagcagacacatttcagtaatttaaacttgatcatttcagtaaaaacaatcatgaggtcaatcatctgttacttaatggagatagtataaagagaagcagaatttacacagagcaaccaaaccaaatatttggtcagtatatttttgggtaacgtagagcagcaaaattattactaactaaataaatctggatcaattaaatagttactttcatagaactttcactagtctataaatccctgactcaggattaaaactgtggaacccagaggaaatacccaggtatgtttaatcttaagaatacttcatataaataacgtttcaatgtaaatatttataaagaaattggttgttatttttcctaggaaggtgtaggaaggttttcttgttgttctcaatcagcactagcttcaatcaggcagaagaaacagcaggtcttggctaatcgaggtgagaacagaatgatgtaatgactaatattgcaacccgttgattttagaaggtcttgtgggcattaagggaaagcagaggaagaatgagaaaatatggtcagagtgacataggacatttgtgacttaatgaccatcgaatcacaggtgttaatctccctctctcaatttgtctttctcattaattacagactctgagagttgtcatagaattgcaaccgtaggttggccaaaaccatctttttaaaatacagaagaaagtttgccttgaattttatatgtgatatgtcattcatgttattttaccacattgttcacagggatgttaaagactattatttacttaagtggttgttccaaaggtgattcagtagttaccattaaaatattatttaaaaacatttttatatcatagagccagaagtaattgaatattgactctcgagggaagacattttctgtcttttatttcatgagctttgatttttctctttctctgcttcaccttctgcactttataccttaagtgggatttatataccacttgaatttaattagcaaaataggcaaaaagtgctaataatctattctcagggcagatgcctattggtgcctgcaaattacacagcgataaggctgaaggataggttcaaaataatgttgaggacttacacattttatagatagtttctttctattcccaaatggtatgtgaaatttttgttctattttttttattggttttcaatagttaattttgatctttatcataagaagctttagttatagactggtatttttttcattgcaatctactttaaatttatggtcagttaagcacatgtatggaagattcgaacattgtctatagtttgaaaaatctatcaacaccttcactgctttcccaatttctttatccaaatacctgttcttccttaacaaatattatgttactgtataagaatctgaattagaagttttaagttaaaatgcattgttattcactacacaatgtttcaaaaataaattttcatttgaaaa

SEQ ID NO: 59 - protein, 404 aa, Homo sapiens
GALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 60 - protein, 303 aa, Homo sapiens
GALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 61 - DNA, 1215 bp, Homo sapiens
ggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttga

SEQ ID NO: 62 - DNA, 912 bp, Homo sapiens
ggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtga

SEQ ID NO: 63 - DNA, 4077 bp, Mus musculus
aagggctgtgttgtaaccttcggagtttgcgcctggagatttcttgggctcttcatccttccttctgtcatattctggcacctgaaagccccaggggcctccggagagactctcactggtactgctgctgctgctcagttctgactctgactcctcactttccacgcccctctccatggagactgattctgcactgccctcctctgggacatcctgagcctccaggtctgtggactcatccatgggagctgcttcgctttcttctccttcctctgcccgttcttcctcctctagtgggggctcttcttcctcttccaccgggggctcctctctcttacctttcacctcctggatttcctcgaccacaggccttcttctagccagcacgatgttttttcttgctttctctccctctgactcagtggactcagactcctctgactccggggtagagctctcctccgcttcctcagatggggtctccgactctgattcttcagttgtctcggactcgctgaactcggactccgtttctgtgtattctgtgtagtcgctggactcctcctctgactccacggtgctttcggtagcttcctcctggtctagagtcagttgaagatagtctttgtcttcttcatcaaggcgcctcctccactcctcgccctcaaggtcaatgcctcttttctcagcgagacctctgactttcttaaaaatcatcgggaatatcctggctctcttccacgttgggtatgtgggctcagccgctggtggcttctcaacggtgactaccacctcctcctcactaggctctctaatttcaactttgggttttttaactttctctggctctacctcttcttcttcatattcctcttcagcttcaccaatgacttcgccgtattcctcctgtccagcaggtggcagcagtcgacggcgacttccatactggggcatctcatacttatgcattgcgctctctcccagttcttcatagagatgtgctcctggtggtggtggtggcgggggcgggggcggcgcaggcgcagctggtacaggagctgcaggcttggctgcaggcatagcagactgaattcttgcggtcttcgtgcactcagcctggcgtactttaaactgtcggtagcttactaagacgaccaagatggctgggatgcaacagaggatgatgatgaaggccaaggccagcaaggccccttctgtgtaccccaagctttctcctcgcttcttgatgctcgtcactgcctcaggtgtccgaatctccagaatgcgccctccttccccgtaatacggctggaagtctttattgatatcgagcagtttgccgtccaggaacttaaaaagctcatttctgtcgatggctctgttggtctgcgggtcgatggcatagacagtcaggtcgcacttgctatagtcttctagggagtaggcgtctccatggcgacgggcacctatggactccaccacaaccttggcaccaggaatttgctcctgaacgtagcgatccaaaatctctgtaaggtcttctatcttcttttccactagtgtagggggcacattggagacaatgacctgcatatccagttgattgaccacggagaccagtacgtctgctttcccgctcaaccccttcccgtagtcgtcagttgcaatcacttgaaacttgaagtaggatcttctcatattgtggaagagcatggctgtcttgatgagacctgtgtatgtttccaccacaaacccctctttgccctctttaatcggcggtatgatgagccggtaggccatggcactgtaattacccgtgtccctgtcggtggccttcactctgagcacagatgcgaacatccttgcgtcttcagacacacctccaatgtagaatttcttctggaacactggggggtgatcgttttcatcctgaatctcaatgtacaccttagctgtattgctttttgaagggactcggagattggcaaggaccacttccagagaatctgcttgtacccggagcacatagctggtccttgtctcgtaatccaatggtgaattcacatagatgaccccagtgacattgttgattccaaacttgtcttcctcatttcctgccacaatggagtacacgatgctctgattaatggcagcagcagaaatgacaccaactacagtccctctggccgcaagctcacttacaggaggaggtctgtattcctcttgggtgaagcgtgggatctctccaggatgtaagacaagaattctcaccgtggcactgctggacatcacaggttcgccgtcatcaaaagccacaaccaccagcttgaaaatcgtagtaggctcttcattaagattgacgcgggttactactcttccagaatcttcctctacatcaaaaatactggctgggtatggaaactgcacgtcgtccactcgatacctcaccctacttgcaggcatcccaggtgggtccgcatcttcagcataaacggtggtgattggtgtccccttgactgcatctggagccaccatccccttgtagatgcgtttgctaaacactggagggtagtcattcatgtccttcacaattaccgtgactgttgctataccaggtggcatagtcccataaatgtcaaaggcctccaccaagaatgtgatgcttgcctcctggtccggaaaggcctcataatccaaactcctcagaagagacaattctccagtgaatggatgcagtgcaaaaaggtgtttcacttctgggcttctgatccgatatgacacattggctccaaggtcaacatccttggcctctatttgaagaaaggaggtcccggctggcagattctcttcaacgacaactgtgtacgttgaattggtaaaaacaggactctgattgttttcgtctagtatttcgatgtgcagactagcaaaggcaggaagtgggtggccattgtcctgctcagccttaataaccaaatcaaatttttgatggaagtctctgtttactggctccaggagagtgagttctgcagtcctgggatgcatatggaagaagcgggggtaatcctcaggggtgccgacaaggatggagtagaggatgccaggtcgatcagatggtggttggatgtttcggtcctgatcaatggcttggataggtggtgtcaccaaaatagggttcagttcttccggagtcctcagttcaggaatggcagcttggtaggtgagtggacgacagtcacgtgtgtttggcacaagaacacaaggcagaaacataggtcccaggtcatctccatctagaacatctactgtgagggtggtggtggttgttcgcctctcattcagattttgtgcacggtcatttgcttggatgatgacatagtagcgagtcttatcctcatagttgagtcttttcctcagtaccacgttgccagtcagcatgagtggaatttcaaaggtgtcgttggatgtcggatcttctgggttgtactgaatcacgtattctatctgtccattagggccatcgtctatgtctgtagctccattgtctcccgagaaccccgtgaatatcgtggtgccaactggagtgagctcattcacggtggcatagtagctttcatgcttgaatgtgggggagttgtcattccgatctcgcaccacgatgcgtacttcatgatagataactgtgccaaccttcttgttgacacactggacttgcaccacaatggagtgtatgttcattggtgggtctctatccagaactcttccggtactgttcaggaaaagcatctgtttaacggggtccagcaacacccagtagtccacgttgtcctttaaagagagctctatggtggggtctggtcctccggcagtccccttaatcaacatgttatccaccagaattgtaccgtttcgactctcttcatcaatggccacgatagtagctggtggtcctcccctagctagtttgcaatcctcgtattgccagtcatcgtcatactggccccagctgactaccaagagagaggcaatgaggatcccatggggtaaacacttccagacagcaaactgtaggaacat

SEQ ID NO: 64 - DNA, 3756 bp, Mus musculus
aagggctgtgttgtaaccttcggagtttgcgcctggagatttcttgggctcttcatccttccttctgtcatattctggcacctgaaagccccaggggcctccggagagactctcactggtactgctgctgctgctcagttctgactctgactcctcactttccacgcccctctccatggagactgattctgcactgccctcctctgggacatcctgagcctccaggtctgtggactcatccatgggagctgcttcgctttcttctccttcctctgcccgttcttcctcctctagtgggggctcttcttcctcttccaccgggggctcctctctcttacctttcacctcctggatttcctcgaccacaggccttcttctagccagcacgatgttttttcttgctttctctccctctgactcagtggactcagactcctctgactccggggtagagctctcctccgcttcctcagatggggtctccgactctgattcttcagttgtctcggactcgctgaactcggactccgtttctgtgtattctgtgtagtcgctggactcctcctctgactccacggtgctttcggtagcttcctcctggtctagagtcagttgaagatagtctttgtcttcttcatcaaggcgcctcctccactcctcgccctcaaggtcaatgcctcttttctcagcgagacctctgactttcttaaaaatcatcgggaatatcctggctctcttccacgttgggtatgtgggctcagccgctggtggcttctcaacggtgactaccacctcctcctcactaggctctctaatttcaactttgggttttttaactttctctggctctacctcttcttcttcatattcctcttcagcttcaccaatgacttcgccgtattcctcctgtccagcaggtggcagcagtcgacggcgacttccatactggggcatctcatacttatgcattgcgctctctcccagttcttcatagagatgtgctcctggtggtggtggtggcgggggcgggggcggcgcaggcgcagctggtacaggagctgcaggcttggctgcaggcatagcagactgaattcttgcggtcttcgtgcactcagcctggcgtactttaaactgtcggtagcttactaagacgaccaagatggctgggatgcaacagaggatgatgatgaaggccaaggccagcaaggccccttctgtgtaccccaagctttctcctcgcttcttgatgctcgtcactgcctcaggtgtccgaatctccagaatgcgccctccttccccgtaatacggctggaagtctttattgatatcgagcagtttgccgtccaggaacttaaaaagctcatttctgtcgatggctctgttggtctgcgggtcgatggcatagacagtcaggtcgcacttgctatagtcttctagggagtaggcgtctccatggcgacgggcacctatggactccaccacaaccttggcaccaggaatttgctcctgaacgtagcgatccaaaatctctgtaaggtcttctatcttcttttccactagtgtagggggcacattggagacaatgacctgcatatccagttgattgaccacggagaccagtacgtctgctttcccgctcaaccccttcccgtagtcgtcagttgcaatcacttgaaacttgaagtaggatcttctcatattgtggaagagcatggctgtcttgatgagacctgtgtatgtttccaccacaaacccctctttgccctctttaatcggcggtatgatgagccggtaggccatggcactgtaattacccgtgtccctgtcggtggccttcactctgagcacagatgcgaacatccttgcgtcttcagacacacctccaatgtagaatttcttctggaacactggggggtgatcgttttcatcctgaatctcaatgtacaccttagctgtattgctttttgaagggactcggagattggcaaggaccacttccagagaatctgcttgtacccggagcacatagctggtccttgtctcgtaatccaatggtgaattcacatagatgaccccagtgacattgttgattccaaacttgtcttcctcatttcctgccacaatggagtacacgatgctctgattaatggcagcagcagaaatgacaccaactacagtccctctggccgcaagctcacttacaggaggaggtctgtattcctcttgggtgaagcgtgggatctctccaggatgtaagacaagaattctcaccgtggcactgctggacatcacaggttcgccgtcatcaaaagccacaaccaccagcttgaaaatcgtagtaggctcttcattaagattgacgcgggttactactcttccagaatcttcctctacatcaaaaatactggctgggtatggaaactgcacgtcgtccactcgatacctcaccctacttgcaggcatcccaggtgggtccgcatcttcagcataaacggtggtgattggtgtccccttgactgcatctggagccaccatccccttgtagatgcgtttgctaaacactggaggctgattgttttcgtctagtatttcgatgtgcagactagcaaaggcaggaagtgggtggccattgtcctgctcagccttaataaccaaatcaaatttttgatggaagtctctgtttactggctccaggagagtgagttctgcagtcctgggatgcatatggaagaagcgggggtaatcctcaggggtgccgacaaggatggagtagaggatgccaggtcgatcagatggtggttggatgtttcggtcctgatcaatggcttggataggtggtgtcaccaaaatagggttcagttcttccggagtcctcagttcaggaatggcagcttggtaggtgagtggacgacagtcacgtgtgtttggcacaagaacacaaggcagaaacataggtcccaggtcatctccatctagaacatctactgtgagggtggtggtggttgttcgcctctcattcagattttgtgcacggtcatttgcttggatgatgacatagtagcgagtcttatcctcatagttgagtcttttcctcagtaccacgttgccagtcagcatgagtggaatttcaaaggtgtcgttggatgtcggatcttctgggttgtactgaatcacgtattctatctgtccattagggccatcgtctatgtctgtagctccattgtctcccgagaaccccgtgaatatcgtggtgccaactggagtgagctcattcacggtggcatagtagctttcatgcttgaatgtgggggagttgtcattccgatctcgcaccacgatgcgtacttcatgatagataactgtgccaaccttcttgttgacacactggacttgcaccacaatggagtgtatgttcattggtgggtctctatccagaactcttccggtactgttcaggaaaagcatctgtttaacggggtccagcaacacccagtagtccacgttgtcctttaaagagagctctatggtggggtctggtcctccggcagtccccttaatcaacatgttatccaccagaattgtaccgtttcgactctcttcatcaatggccacgatagtagctggtggtcctcccctagctagtttgcaatcctcgtattgccagtcatcgtcatactggccccagctgactaccaagagagaggcaatgaggatcccatggggtaaacacttccagacagcaaactgtaggaacat

SEQ ID NO: 65 - DNA, 4032 bp, Mus musculus
aagggctgtgttgtaaccttcggagtttgcgcctggagatttcttgggctcttcatccttccttctgtcatattctggcacctgaaagccccaggggcctccggagagactctcactggtactgctgctgctgctcagttctgactctgactcctcactttccacgcccctctccatggagactgattctgcactgccctcctctgggacatcctgagcctccaggtctgtggactcatccatgggagctgcttcgctttcttctccttcctctgcccgttcttcctcctctagtgggggctcttcttcctcttccaccgggggctcctctctcttacctttcacctcctggatttcctcgaccacaggccttcttctagccagcacgatgttttttcttgctttctctccctctgactcagtggactcagactcctctgactccggggtagagctctcctccgcttcctcagatggggtctccgactctgattcttcagttgtctcggactcgctgaactcggactccgtttctgtgtattctgtgtagtcgctggactcctcctctgactccacggtgctttcggtagcttcctcctggtctagagtcagttgaagatagtctttgtcttcttcatcaaggcgcctcctccactcctcgccctcaaggtcaatgcctcttttctcagcgagacctctgactttcttaaaaatcatcgggaatatcctggctctcttccacgttgggtatgtgggctcagccgctggtggcttctcaacggtgactaccacctcctcctcactaggctctctaatttcaactttgggttttttaactttctctggctctacctcttcttcttcatattcctcttcagcttcaccaatgacttcgccgtattcctcctgtccagcaggtggcagcagtcgacggcgacttccatactggggcatctcatacttatgcattgcgctctctcccagttcttcatagagatgtgctcctggtggtggtggtggcgggggcgggggcggcgcaggcgcagctggtacaggagctgcaggcttggctgcaggcatagcagactgaattcttgcggtcttcgtgcactcagcctggcgtactttaaactgtcggtagcttactaagacgaccaagatggctgggatgcaacagaggatgatgatgaaggccaaggccagcaaggccccttctgtgtaccccaagctttctcctcgcttcttgatgctcgtcactgcctcaggtgtccgaatctccagaatgcgccctccttccccgtaatacggctggaagtctttattgatatcgagcagtttgccgtccaggaacttaaaaagctcatttctgtcgatggctctgttggtctgcgggtcgatggcatagacagtcaggtcgcacttgctatagtcttctagggagtaggcgtctccatggcgacgggcacctatggactccaccacaaccttggcaccaggaatttgctcctgaacgtagcgatccaaaatctctgtaaggtcttctatcttcttttccactagtgtagggggcacattggagacaatgacctgcatatccagttgattgaccacggagaccagtacgtctgctttcccgctcaaccccttcccgtagtcgtcagttgcaatcacttgaaacttgaagtaggatcttctcatattgtggaagagcatggctgtcttgatgagacctgtgtatgtttccaccacaaacccctctttgccctctttaatcggcggtatgatgagccggtaggccatggcactgtaattacccgtgtccctgtcggtggccttcactctgagcacagatgcgaacatccttgcgtcttcagacacacctccaatgtagaatttcttctggaacactggggggttatcatcaatgtccaacaccttgatgtacagtgtcagagttgaatgtcgagggtggactgctccatctgttgccacgacaaccagttcatagtggtccctggcttccctgttcagcttcacggctgtgtaaatgctcccgttggatgtgatgcggaagaggttgttgaagttccccaggctgtagtgaacttggccgtttatcccagcatctgggtctgttgcccggacttgacccacaaaggcattggcttcttcctccaccacagagaggttcctgggcagatagggatcgaacacgggagcgttgtcattgacgtccgtcaccactatgttcacagtggcagttgaggttccatccggtctgccatctgaggctgtgacgatgaggatgtagcggtctgtgctctcgcggtctagagccttccctaggctgagaatccctgtggtttctgaaagattaaaaactctctgagggtctccattctcgatggcatatgtgattggatctccctctcgatcagttgcctgtagatttaataaaatagcaccgatcctcatggcctcgctgacttccagactgtacatcagctgcgggaagcggggagggctctggttgttaggaggaagcacctcgatgtacactgtgcagatggagtgccttctttctgcaggcggggcgttgtccgaagcctgcactgtgagcgcatacgtctgtcccacgatcagctccacgcctggtgcaatgctcaccagccctgtggtcttgttgatcacgaagtctcccttgccccccaccagtatttcataggagatctccccattagagccttcatcagcatctaccgctgtcagctgaatgacgctgtccccaggactcatgtctgtgtaaacatagacatcataggagatttcagggaaggtgggcgtctgattgttttcgtctagtatttcgatgtgcagactagcaaaggcaggaagtgggtggccattgtcctgctcagccttaataaccaaatcaaatttttgatggaagtctctgtttactggctccaggagagtgagttctgcagtcctgggatgcatatggaagaagcgggggtaatcctcaggggtgccgacaaggatggagtagaggatgccaggtcgatcagatggtggttggatgtttcggtcctgatcaatggcttggataggtggtgtcaccaaaatagggttcagttcttccggagtcctcagttcaggaatggcagcttggtaggtgagtggacgacagtcacgtgtgtttggcacaagaacacaaggcagaaacataggtcccaggtcatctccatctagaacatctactgtgagggtggtggtggttgttcgcctctcattcagattttgtgcacggtcatttgcttggatgatgacatagtagcgagtcttatcctcatagttgagtcttttcctcagtaccacgttgccagtcagcatgagtggaatttcaaaggtgtcgttggatgtcggatcttctgggttgtactgaatcacgtattctatctgtccattagggccatcgtctatgtctgtagctccattgtctcccgagaaccccgtgaatatcgtggtgccaactggagtgagctcattcacggtggcatagtagctttcatgcttgaatgtgggggagttgtcattccgatctcgcaccacgatgcgtacttcatgatagataactgtgccaaccttcttgttgacacactggacttgcaccacaatggagtgtatgttcattggtgggtctctatccagaactcttccggtactgttcaggaaaagcatctgtttaacggggtccagcaacacccagtagtccacgttgtcctttaaagagagctctatggtggggtctggtcctccggcagtccccttaatcaacatgttatccaccagaattgtaccgtttcgactctcttcatcaatggccacgatagtagctggtggtcctcccctagctagtttgcaatcctcgtattgccagtcatcgtcatactggccccagctgactaccaagagagaggcaatgaggatcccatggggtaaacacttccagacagcaaactgtaggaacat

SEQ ID NO: 66 - DNA, 4071 bp, Mus musculus
aagggctgtgttgtaaccttcggagtttgcgcctggagatttcttgggctcttcatccttccttctgtcatattctggcacctgaaagccccaggggcctccggagagactctcactggtactgctgctgctgctcagttctgactctgactcctcactttccacgcccctctccatggagactgattctgcactgccctcctctgggacatcctgagcctccaggtctgtggactcatccatgggagctgcttcgctttcttctccttcctctgcccgttcttcctcctctagtgggggctcttcttcctcttccaccgggggctcctctctcttacctttcacctcctggatttcctcgaccacaggccttcttctagccagcacgatgttttttcttgctttctctccctctgactcagtggactcagactcctctgactccggggtagagctctcctccgcttcctcagatggggtctccgactctgattcttcagttgtctcggactcgctgaactcggactccgtttctgtgtattctgtgtagtcgctggactcctcctctgactccacggtgctttcggtagcttcctcctggtctagagtcagttgaagatagtctttgtcttcttcatcaaggcgcctcctccactcctcgccctcaaggtcaatgcctcttttctcagcgagacctctgactttcttaaaaatcatcgggaatatcctggctctcttccacgttgggtatgtgggctcagccgctggtggcttctcaacggtgactaccacctcctcctcactaggctctctaatttcaactttgggttttttaactttctctggctctacctcttcttcttcatattcctcttcagcttcaccaatgacttcgccgtattcctcctgtccagcaggtggcagcagtcgacggcgacttccatactggggcatctcatacttatgcattgcgctctctcccagttcttcatagagatgtgctcctggtggtggtggtggcgggggcgggggcggcgcaggcgcagctggtacaggagctgcaggcttggctgcaggcatagcagactgaattcttgcggtcttcgtgcactcagcctggcgtactttaaactgtcggtagcttactaagacgaccaagatggctgggatgcaacagaggatgatgatgaaggccaaggccagcaaggccccttctgtgtaccccaagctttctcctcgcttcttgatgctcgtcactgcctcaggtgtccgaatctccagaatgcgccctccttccccgtaatacggctggaagtctttattgatatcgagcagtttgccgtccaggaacttaaaaagctcatttctgtcgatggctctgttggtctgcgggtcgatggcatagacagtcaggtcgcacttgctatagtcttctagggagtaggcgtctccatggcgacgggcacctatggactccaccacaaccttggcaccaggaatttgctcctgaacgtagcgatccaaaatctctgtaaggtcttctatcttcttttccactagtgtagggggcacattggagacaatgacctgcatatccagttgattgaccacggagaccagtacgtctgctttcccgctcaaccccttcccgtagtcgtcagttgcaatcacttgaaacttgaagtaggatcttctcatattgtggaagagcatggctgtcttgatgagacctgtgtatgtttccaccacaaacccctctttgccctctttaatcggcggtatgatgagccggtaggccatggcactgtaattacccgtgtccctgtcggtggccttcactctgagcacagatgcgaacatccttgcgtcttcagacacacctccaatgtagaatttcttctggaacactggggggtagtcattcatgtccttcacaattaccgtgactgttgctataccaggtggcatagtcccataaatgtcaaaggcctccaccaagaatgtgatgcttgcctcctggtccggaaaggcctcataatccaaactcctcagaagagacaattctccagtgaatggatgcagtgcaaaaaggtgtttcacttctgggcttctgatccgatatgacacattggctccaaggtcaacatccttggcctctatttgaagaaaggaggtcccggctggcagattctcttcaacgacaactgtgtacgttgaattggtaaaaacaggactgttatcatcaatgtccaacaccttgatgtacagtgtcagagttgaatgtcgagggtggactgctccatctgttgccacgacaaccagttcatagtggtccctggcttccctgttcagcttcacggctgtgtaaatgctcccgttggatgtgatgcggaagaggttgttgaagttccccaggctgtagtgaacttggccgtttatcccagcatctgggtctgttgcccggacttgacccacaaaggcattggcttcttcctccaccacagagaggttcctgggcagatagggatcgaacacgggagcgttatcatttgcatccatcactcggatattgaccacgactggctcactttcttgcacgccatcaaacgctgttatcagaaaggtgtaggtttgctgttcctccctgtccacaggttgaagcagggtgaggtagcgggtgataccagtgggtgtcacagtgaagaccgaggtgtagtcattcaggaagaggtggagctctggatcttttgtgtcttctatgtctttgtccagagctacaattctcagaggagtggttaagtttaggctctcagaaatggtggctcccactggggcggattccaggatgtatccttgatagctgggcattgtgaagtatggactctgattgttttcgtctagtatttcgatgtgcagactagcaaaggcaggaagtgggtggccattgtcctgctcagccttaataaccaaatcaaatttttgatggaagtctctgtttactggctccaggagagtgagttctgcagtcctgggatgcatatggaagaagcgggggtaatcctcaggggtgccgacaaggatggagtagaggatgccaggtcgatcagatggtggttggatgtttcggtcctgatcaatggcttggataggtggtgtcaccaaaatagggttcagttcttccggagtcctcagttcaggaatggcagcttggtaggtgagtggacgacagtcacgtgtgtttggcacaagaacacaaggcagaaacataggtcccaggtcatctccatctagaacatctactgtgagggtggtggtggttgttcgcctctcattcagattttgtgcacggtcatttgcttggatgatgacatagtagcgagtcttatcctcatagttgagtcttttcctcagtaccacgttgccagtcagcatgagtggaatttcaaaggtgtcgttggatgtcggatcttctgggttgtactgaatcacgtattctatctgtccattagggccatcgtctatgtctgtagctccattgtctcccgagaaccccgtgaatatcgtggtgccaactggagtgagctcattcacggtggcatagtagctttcatgcttgaatgtgggggagttgtcattccgatctcgcaccacgatgcgtacttcatgatagataactgtgccaaccttcttgttgacacactggacttgcaccacaatggagtgtatgttcattggtgggtctctatccagaactcttccggtactgttcaggaaaagcatctgtttaacggggtccagcaacacccagtagtccacgttgtcctttaaagagagctctatggtggggtctggtcctccggcagtccccttaatcaacatgttatccaccagaattgtaccgtttcgactctcttcatcaatggccacgatagtagctggtggtcctcccctagctagtttgcaatcctcgtattgccagtcatcgtcatactggccccagctgactaccaagagagaggcaatgaggatcccatggggtaaacacttccagacagcaaactgtaggaacat

SEQ ID NO: 67 - DNA, 3729 bp, Mus musculus
aagggctgtgttgtaaccttcggagtttgcgcctggagatttcttgggctcttcatccttccttctgtcatattctggcacctgaaagccccaggggcctccggagagactctcactggtactgctgctgctgctcagttctgactctgactcctcactttccacgcccctctccatggagactgattctgcactgccctcctctgggacatcctgagcctccaggtctgtggactcatccatgggagctgcttcgctttcttctccttcctctgcccgttcttcctcctctagtgggggctcttcttcctcttccaccgggggctcctctctcttacctttcacctcctggatttcctcgaccacaggccttcttctagccagcacgatgttttttcttgctttctctccctctgactcagtggactcagactcctctgactccggggtagagctctcctccgcttcctcagatggggtctccgactctgattcttcagttgtctcggactcgctgaactcggactccgtttctgtgtattctgtgtagtcgctggactcctcctctgactccacggtgctttcggtagcttcctcctggtctagagtcagttgaagatagtctttgtcttcttcatcaaggcgcctcctccactcctcgccctcaaggtcaatgcctcttttctcagcgagacctctgactttcttaaaaatcatcgggaatatcctggctctcttccacgttgggtatgtgggctcagccgctggtggcttctcaacggtgactaccacctcctcctcactaggctctctaatttcaactttgggttttttaactttctctggctctacctcttcttcttcatattcctcttcagcttcaccaatgacttcgccgtattcctcctgtccagcaggtggcagcagtcgacggcgacttccatactggggcatctcatacttatgcattgcgctctctcccagttcttcatagagatgtgctcctggtggtggtggtggcgggggcgggggcggcgcaggcgcagctggtacaggagctgcaggcttggctgcaggcatagcagactgaattcttgcggtcttcgtgcactcagcctggcgtactttaaactgtcggtagcttactaagacgaccaagatggctgggatgcaacagaggatgatgatgaaggccaaggccagcaaggccccttctgtgtaccccaagctttctcctcgcttcttgatgctcgtcactgcctcaggtgtccgaatctccagaatgcgccctccttccccgtaatacggctggaagtctttattgatatcgagcagtttgccgtccaggaacttaaaaagctcatttctgtcgatggctctgttggtctgcgggtcgatggcatagacagtcaggtcgcacttgctatagtcttctagggagtaggcgtctccatggcgacgggcacctatggactccaccacaaccttggcaccaggaatttgctcctgaacgtagcgatccaaaatctctgtaaggtcttctatcttcttttccactagtgtagggggcacattggagacaatgacctgcatatccagttgattgaccacggagaccagtacgtctgctttcccgctcaaccccttcccgtagtcgtcagttgcaatcacttgaaacttgaagtaggatcttctcatattgtggaagagcatggctgtcttgatgagacctgtgtatgtttccaccacaaacccctctttgccctctttaatcggcggtatgatgagccggtaggccatggcactgtaattacccgtgtccctgtcggtggccttcactctgagcacagatgcgaacatccttgcgtcttcagacacacctccaatgtagaatttcttctggaacactggggggtagtcattcatgtccttcacaattaccgtgactgttgctataccaggtggcatagtcccataaatgtcaaaggcctccaccaagaatgtgatgcttgcctcctggtccggaaaggcctcataatccaaactcctcagaagagacaattctccagtgaatggatgcagtgcaaaaaggtgtttcacttctgggcttctgatccgatatgacacattggctccaaggtcaacatccttggcctctatttgaagaaaggaggtcccggctggcagattctcttcaacgacaactgtgtacgttgaattggtaaaaacaggactgttatcatcaatgtccaacaccttgatgtacagtgtcagagttgaatgtcgagggtggactgctccatctgttgccacgacaaccagttcatagtggtccctggcttccctgttcagcttcacggctgtgtaaatgctcccgttggatgtgatgcggaagaggttgttgaagttccccaggctgtagtgaacttggccgtttatcccagcatctgggtctgttgcccggacttgacccacaaaggcattggcttcttcctccaccacagagaggttcctgggcagatagggatcgaacacgggagcctgattgttttcgtctagtatttcgatgtgcagactagcaaaggcaggaagtgggtggccattgtcctgctcagccttaataaccaaatcaaatttttgatggaagtctctgtttactggctccaggagagtgagttctgcagtcctgggatgcatatggaagaagcgggggtaatcctcaggggtgccgacaaggatggagtagaggatgccaggtcgatcagatggtggttggatgtttcggtcctgatcaatggcttggataggtggtgtcaccaaaatagggttcagttcttccggagtcctcagttcaggaatggcagcttggtaggtgagtggacgacagtcacgtgtgtttggcacaagaacacaaggcagaaacataggtcccaggtcatctccatctagaacatctactgtgagggtggtggtggttgttcgcctctcattcagattttgtgcacggtcatttgcttggatgatgacatagtagcgagtcttatcctcatagttgagtcttttcctcagtaccacgttgccagtcagcatgagtggaatttcaaaggtgtcgttggatgtcggatcttctgggttgtactgaatcacgtattctatctgtccattagggccatcgtctatgtctgtagctccattgtctcccgagaaccccgtgaatatcgtggtgccaactggagtgagctcattcacggtggcatagtagctttcatgcttgaatgtgggggagttgtcattccgatctcgcaccacgatgcgtacttcatgatagataactgtgccaaccttcttgttgacacactggacttgcaccacaatggagtgtatgttcattggtgggtctctatccagaactcttccggtactgttcaggaaaagcatctgtttaacggggtccagcaacacccagtagtccacgttgtcctttaaagagagctctatggtggggtctggtcctccggcagtccccttaatcaacatgttatccaccagaattgtaccgtttcgactctcttcatcaatggccacgatagtagctggtggtcctcccctagctagtttgcaatcctcgtattgccagtcatcgtcatactggccccagctgactaccaagagagaggcaatgaggatcccatggggtaaacacttccagacagcaaactgtaggaacat

SEQ ID NO: 68 - DNA, 3750 bp, Mus musculus
aagggctgtgttgtaaccttcggagtttgcgcctggagatttcttgggctcttcatccttccttctgtcatattctggcacctgaaagccccaggggcctccggagagactctcactggtactgctgctgctgctcagttctgactctgactcctcactttccacgcccctctccatggagactgattctgcactgccctcctctgggacatcctgagcctccaggtctgtggactcatccatgggagctgcttcgctttcttctccttcctctgcccgttcttcctcctctagtgggggctcttcttcctcttccaccgggggctcctctctcttacctttcacctcctggatttcctcgaccacaggccttcttctagccagcacgatgttttttcttgctttctctccctctgactcagtggactcagactcctctgactccggggtagagctctcctccgcttcctcagatggggtctccgactctgattcttcagttgtctcggactcgctgaactcggactccgtttctgtgtattctgtgtagtcgctggactcctcctctgactccacggtgctttcggtagcttcctcctggtctagagtcagttgaagatagtctttgtcttcttcatcaaggcgcctcctccactcctcgccctcaaggtcaatgcctcttttctcagcgagacctctgactttcttaaaaatcatcgggaatatcctggctctcttccacgttgggtatgtgggctcagccgctggtggcttctcaacggtgactaccacctcctcctcactaggctctctaatttcaactttgggttttttaactttctctggctctacctcttcttcttcatattcctcttcagcttcaccaatgacttcgccgtattcctcctgtccagcaggtggcagcagtcgacggcgacttccatactggggcatctcatacttatgcattgcgctctctcccagttcttcatagagatgtgctcctggtggtggtggtggcgggggcgggggcggcgcaggcgcagctggtacaggagctgcaggcttggctgcaggcatagcagactgaattcttgcggtcttcgtgcactcagcctggcgtactttaaactgtcggtagcttactaagacgaccaagatggctgggatgcaacagaggatgatgatgaaggccaaggccagcaaggccccttctgtgtaccccaagctttctcctcgcttcttgatgctcgtcactgcctcaggtgtccgaatctccagaatgcgccctccttccccgtaatacggctggaagtctttattgatatcgagcagtttgccgtccaggaacttaaaaagctcatttctgtcgatggctctgttggtctgcgggtcgatggcatagacagtcaggtcgcacttgctatagtcttctagggagtaggcgtctccatggcgacgggcacctatggactccaccacaaccttggcaccaggaatttgctcctgaacgtagcgatccaaaatctctgtaaggtcttctatcttcttttccactagtgtagggggcacattggagacaatgacctgcatatccagttgattgaccacggagaccagtacgtctgctttcccgctcaaccccttcccgtagtcgtcagttgcaatcacttgaaacttgaagtaggatcttctcatattgtggaagagcatggctgtcttgatgagacctgtgtatgtttccaccacaaacccctctttgccctctttaatcggcggtatgatgagccggtaggccatggcactgtaattacccgtgtccctgtcggtggccttcactctgagcacagatgcgaacatccttgcgtcttcagacacacctccaatgtagaatttcttctggaacactggggggttatcatcaatgtccaacaccttgatgtacagtgtcagagttgaatgtcgagggtggactgctccatctgttgccacgacaaccagttcatagtggtccctggcttccctgttcagcttcacggctgtgtaaatgctcccgttggatgtgatgcggaagaggttgttgaagttccccaggctgtagtgaacttggccgtttatcccagcatctgggtctgttgcccggacttgacccacaaaggcattggcttcttcctccaccacagagaggttcctgggcagatagggatcgaacacgggagcgttatcatttgcatccatcactcggatattgaccacgactggctcactttcttgcacgccatcaaacgctgttatcagaaaggtgtaggtttgctgttcctccctgtccacaggttgaagcagggtgaggtagcgggtgataccagtgggtgtcacagtgaagaccgaggtgtagtcattcaggaagaggtggagctctggatcttttgtgtcttctatgtctttgtccagagctacaattctcagaggagtggttaagtttaggctctcagaaatggtggctcccactggggcggattccaggatgtatccttgatagctgggcattgtgaagtatggactctgattgttttcgtctagtatttcgatgtgcagactagcaaaggcaggaagtgggtggccattgtcctgctcagccttaataaccaaatcaaatttttgatggaagtctctgtttactggctccaggagagtgagttctgcagtcctgggatgcatatggaagaagcgggggtaatcctcaggggtgccgacaaggatggagtagaggatgccaggtcgatcagatggtggttggatgtttcggtcctgatcaatggcttggataggtggtgtcaccaaaatagggttcagttcttccggagtcctcagttcaggaatggcagcttggtaggtgagtggacgacagtcacgtgtgtttggcacaagaacacaaggcagaaacataggtcccaggtcatctccatctagaacatctactgtgagggtggtggtggttgttcgcctctcattcagattttgtgcacggtcatttgcttggatgatgacatagtagcgagtcttatcctcatagttgagtcttttcctcagtaccacgttgccagtcagcatgagtggaatttcaaaggtgtcgttggatgtcggatcttctgggttgtactgaatcacgtattctatctgtccattagggccatcgtctatgtctgtagctccattgtctcccgagaaccccgtgaatatcgtggtgccaactggagtgagctcattcacggtggcatagtagctttcatgcttgaatgtgggggagttgtcattccgatctcgcaccacgatgcgtacttcatgatagataactgtgccaaccttcttgttgacacactggacttgcaccacaatggagtgtatgttcattggtgggtctctatccagaactcttccggtactgttcaggaaaagcatctgtttaacggggtccagcaacacccagtagtccacgttgtcctttaaagagagctctatggtggggtctggtcctccggcagtccccttaatcaacatgttatccaccagaattgtaccgtttcgactctcttcatcaatggccacgatagtagctggtggtcctcccctagctagtttgcaatcctcgtattgccagtcatcgtcatactggccccagctgactaccaagagagaggcaatgaggatcccatggggtaaacacttccagacagcaaactgtaggaacat

SEQ ID NO: 69 - DNA, 5373 bp, Mus musculus
atgttcctacagtttgctgtctggaagtgtttaccccatgggatcctcattgcctctctcttggtagtcagctggggccagtatgacgatgactggcaatacgaggattgcaaactagctaggggaggaccaccagctactatcgtggccattgatgaagagagtcgaaacggtacaattctggtggataacatgttgattaaggggactgccggaggaccagaccccaccatagagctctctttaaaggacaacgtggactactgggtgttgctggaccccgttaaacagatgcttttcctgaacagtaccggaagagttctggatagagacccaccaatgaacatacactccattgtggtgcaagtccagtgtgtcaacaagaaggttggcacagttatctatcatgaagtacgcatcgtggtgcgagatcggaatgacaactcccccacattcaagcatgaaagctactatgccaccgtgaatgagctcactccagttggcaccacgatattcacggggttctcgggagacaatggagctacagacatagacgatggccctaatggacagatagaatacgtgattcagtacaacccagaagatccgacatccaacgacacctttgaaattccactcatgctgactggcaacgtggtactgaggaaaagactcaactatgaggataagactcgctactatgtcatcatccaagcaaatgaccgtgcacaaaatctgaatgagaggcgaacaaccaccaccaccctcacagtagatgttctagatggagatgacctgggacctatgtttctgccttgtgttcttgtgccaaacacacgtgactgtcgtccactcacctaccaagctgccattcctgaactgaggactccggaagaactgaaccctattttggtgacaccacctatccaagccattgatcaggaccgaaacatccaaccaccatctgatcgacctggcatcctctactccatccttgtcggcacccctgaggattacccccgcttcttccatatgcatcccaggactgcagaactcactctcctggagccagtaaacagagacttccatcaaaaatttgatttggttattaaggctgagcaggacaatggccacccacttcctgcctttgctagtctgcacatcgaaatactagacgaaaacaatcagagtccatacttcacaatgcccagctatcaaggatacatcctggaatccgccccagtgggagccaccatttctgagagcctaaacttaaccactcctctgagaattgtagctctggacaaagacatagaagacgtgccacctggtggagttcctacaaaagatccagagctccacctcttcctgaatgactacacctcggtcttcactgtgacacccactggtatcacccgctacctcaccctgcttcaacctgtggacagggaggaacagcaaacctacacctttctgataacagcgtttgatggcgtgcaagaaagtgagccagtcgtggtcaatatccgagtgatggatgcaaatgataacacgcccaccttccctgaaatctcctatgatgtctatgtttacacagacatgagtcctggggacagcgtcattcagctgacagcggtagatgctgatgaaggctctaatggggagatctcctatgaaatactggtggggggcaagggagacttcgtgatcaacaagaccacagggctggtgagcattgcaccaggcgtggagctgatcgtgggacagacgtatgcgctcacagtgcaggcttcggacaacgccccgcctgcagaaagaaggcactccatctgcacagtgtacatcgaggtgcttcctcctaacaaccagagccctccccgcttcccgcagctgatgtacagtctggaagtcagcgaggccatgaggatcggtgctattttattaaatctacaggcaactgatcgagagggagatccaatcacatatgccatcgagaatggagaccctcagagagtttttaatctttcagaaaccacagggattctcagcctagggaaggctctagaccgcgagagcacagaccgctacatcctcatcgtcacagcctcagatggcagaccggatggaacctcaactgccactgtgaacatagtggtgacggacgtcaatgacaacgctcccgtgttcgatccctatctgcccaggaacctctctgtggtggaggaagaagccaatgcctttgtgggtcaagtccgggcaacagacccagatgctgggataaacggccaagttcactacagcctggggaacttcaacaacctcttccgcatcacatccaacgggagcatttacacagccgtgaagctgaacagggaagccagggaccactatgaactggttgtcgtggcaacagatggagcagtccaccctcgacattcaactctgacactgtacatcaaggtgttggacattgatgataacagtcctgtttttaccaattcaacgtacacagttgtcgttgaagagaatctgccagccgggacctcctttcttcaaatagaggccaaggatgttgaccttggagccaatgtgtcatatcggatcagaagcccagaagtgaaacacctttttgcactgcatccattcactggagaattgtctcttctgaggagtttggattatgaggcctttccggaccaggaggcaagcatcacattcttggtggaggcctttgacatttatgggactatgccacctggtatagcaacagtcacggtaattgtgaaggacatgaatgactaccctccagtgtttagcaaacgcatctacaaggggatggtggctccagatgcagtcaaggggacaccaatcaccaccgtttatgctgaagatgcggacccacctgggatgcctgcaagtagggtgaggtatcgagtggacgacgtgcagtttccatacccagccagtatttttgatgtagaggaagattctggaagagtagtaacccgcgtcaatcttaatgaagagcctactacgattttcaagctggtggttgtggcttttgatgacggcgaacctgtgatgtccagcagtgccacggtgagaattcttgtcttacatcctggagagatcccacgcttcacccaagaggaatacagacctcctcctgtaagtgagcttgcggccagagggactgtagttggtgtcatttctgctgctgccattaatcagagcatcgtgtactccattgtggcaggaaatgaggaagacaagtttggaatcaacaatgtcactggggtcatctatgtgaattcaccattggattacgagacaaggaccagctatgtgctccgggtacaagcagattctctggaagtggtccttgccaatctccgagtcccttcaaaaagcaatacagctaaggtgtacattgagattcaggatgaaaacgatcaccccccagtgttccagaagaaattctacattggaggtgtgtctgaagacgcaaggatgttcgcatctgtgctcagagtgaaggccaccgacagggacacgggtaattacagtgccatggcctaccggctcatcataccgccgattaaagagggcaaagaggggtttgtggtggaaacatacacaggtctcatcaagacagccatgctcttccacaatatgagaagatcctacttcaagtttcaagtgattgcaactgacgactacgggaaggggttgagcgggaaagcagacgtactggtctccgtggtcaatcaactggatatgcaggtcattgtctccaatgtgccccctacactagtggaaaagaagatagaagaccttacagagattttggatcgctacgttcaggagcaaattcctggtgccaaggttgtggtggagtccataggtgcccgtcgccatggagacgcctactccctagaagactatagcaagtgcgacctgactgtctatgccatcgacccgcagaccaacagagccatcgacagaaatgagctttttaagttcctggacggcaaactgctcgatatcaataaagacttccagccgtattacggggaaggagggcgcattctggagattcggacacctgaggcagtgacgagcatcaagaagcgaggagaaagcttggggtacacagaaggggccttgctggccttggccttcatcatcatcctctgttgcatcccagccatcttggtcgtcttagtaagctaccgacagtttaaagtacgccaggctgagtgcacgaagaccgcaagaattcagtctgctatgcctgcagccaagcctgcagctcctgtaccagctgcgcctgcgccgcccccgcccccgccaccaccaccaccaggagcacatctctatgaagaactgggagagagcgcaatgcataagtatgagatgccccagtatggaagtcgccgtcgactgctgccacctgctggacaggaggaatacggcgaagtcattggtgaagctgaagaggaatatgaagaagaagaggtagagccagagaaagttaaaaaacccaaagttgaaattagagagcctagtgaggaggaggtggtagtcaccgttgagaagccaccagcggctgagcccacatacccaacgtggaagagagccaggatattcccgatgatttttaagaaagtcagaggtctcgctgagaaaagaggcattgaccttgagggcgaggagtggaggaggcgccttgatgaagaagacaaagactatcttcaactgactctagaccaggaggaagctaccgaaagcaccgtggagtcagaggaggagtccagcgactacacagaatacacagaaacggagtccgagttcagcgagtccgagacaactgaagaatcagagtcggagaccccatctgaggaagcggaggagagctctaccccggagtcagaggagtctgagtccactgagtcagagggagagaaagcaagaaaaaacatcgtgctagctagaagaaggcctgtggtcgaggaaatccaggaggtgaaaggtaagagagaggagcccccggtggaagaggaagaagagcccccactagaggaggaagaacgggcagaggaaggagaagaaagcgaagcagctcccatggatgagtccacagacctggaggctcaggatgtcccagaggagggcagtgcagaatcagtctccatggagaggggcgtggaaagtgaggagtcagagtcagaactgagcagcagcagcagtaccagtgagagtctctccggaggcccctggggctttcaggtgccagaatatgacagaaggaaggatgaagagcccaagaaatctccaggcgcaaactccgaaggttacaacacagccctttag

SEQ ID NO: 70 - protein, 1790 aa, Mus musculus
MFLQFAVWKCLPHGILIASLLVVSWGQYDDDWQYEDCKLARGGPPATIVAIDEESRNGTILVDNMLIKGTAGGPDPTIELSLKDNVDYWVLLDPVKQMLFLNSTGRVLDRDPPMNIHSIVVQVQCVNKKVGTVIYHEVRIVVRDRNDNSPTFKHESYYATVNELTPVGTTIFTGFSGDNGATDIDDGPNGQIEYVIQYNPEDPTSNDTFEIPLMLTGNVVLRKRLNYEDKTRYYVIIQANDRAQNLNERRTTTTTLTVDVLDGDDLGPMFLPCVLVPNTRDCRPLTYQAAIPELRTPEELNPILVTPPIQAIDQDRNIQPPSDRPGILYSILVGTPEDYPRFFHMHPRTAELTLLEPVNRDFHQKFDLVIKAEQDNGHPLPAFASLHIEILDENNQSPYFTMPSYQGYILESAPVGATISESLNLTTPLRIVALDKDIEDVPPGGVPTKDPELHLFLNDYTSVFTVTPTGITRYLTLLQPVDREEQQTYTFLITAFDGVQESEPVVVNIRVMDANDNTPTFPEISYDVYVYTDMSPGDSVIQLTAVDADEGSNGEISYEILVGGKGDFVINKTTGLVSIAPGVELIVGQTYALTVQASDNAPPAERRHSICTVYIEVLPPNNQSPPRFPQLMYSLEVSEAMRIGAILLNLQATDREGDPITYAIENGDPQRVFNLSETTGILSLGKALDRESTDRYILIVTASDGRPDGTSTATVNIVVTDVNDNAPVFDPYLPRNLSVVEEEANAFVGQVRATDPDAGINGQVHYSLGNFNNLFRITSNGSIYTAVKLNREARDHYELVVVATDGAVHPRHSTLTLYIKVLDIDDNSPVFTNSTYTVVVEENLPAGTSFLQIEAKDVDLGANVSYRIRSPEVKHLFALHPFTGELSLLRSLDYEAFPDQEASITFLVEAFDIYGTMPPGIATVTVIVKDMNDYPPVFSKRIYKGMVAPDAVKGTPITTVYAEDADPPGMPASRVRYRVDDVQFPYPASIFDVEEDSGRVVTRVNLNEEPTTIFKLVVVAFDDGEPVMSSSATVRILVLHPGEIPRFTQEEYRPPPVSELAARGTVVGVISAAAINQSIVYSIVAGNEEDKFGINNVTGVIYVNSPLDYETRTSYVLRVQADSLEVVLANLRVPSKSNTAKVYIEIQDENDHPPVFQKKFYIGGVSEDARMFASVLRVKATDRDTGNYSAMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAYSLEDYSKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQSAMPAAKPAAPVPAAPAPPPPPPPPPPGAHLYEELGESAMHKYEMPQYGSRRRLLPPAGQEEYGEVIGEAEEEYEEEEVEPEKVKKPKVEIREPSEEEVVVTVEKPPAAEPTYPTWKRARIFPMIFKKVRGLAEKRGIDLEGEEWRRRLDEEDKDYLQLTLDQEEATESTVESEEESSDYTEYTETESEFSESETTEESESETPSEEAEESSTPESEESESTESEGEKARKNIVLARRRPVVEEIQEVKGKREEPPVEEEEEPPLEEEERAEEGEESEAAPMDESTDLEAQDVPEEGSAESVSMERGVESEESESELSSSSSTSESLSGGPWGFQVPEYDRRKDEEPKKSPGANSEGYNTAL

SEQ ID NO: 71 - protein, 1213 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 72 - DNA, 3642 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaacccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaa

SEQ ID NO: 73 - protein, 1089 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSLSEQIDN

SEQ ID NO: 74 - DNA, 3252 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaa

SEQ ID NO: 75 - protein, 1460 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 76 - protein, 1359 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 77 - DNA, 4383 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttga

SEQ ID NO: 78 - DNA, 4080 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtga

SEQ ID NO: 79 - protein, 1473 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 80 - protein, 1372 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 81 - DNA, 4422 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttga

SEQ ID NO: 82 - DNA, 4119 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtga

SEQ ID NO: 83 - protein, 1359 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 84 - protein, 1258 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 85 - DNA, 4080 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttga

SEQ ID NO: 86 - DNA, 3777 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtga

SEQ ID NO: 87 - protein, 1344 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 88 - protein, 1243 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 89 - DNA, 4035 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataaccccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttga

SEQ ID NO: 90 - DNA, 3732 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataaccccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtga

SEQ ID NO: 91 - protein, 1357 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 92 - protein, 1256 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 93 - DNA, 4074 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttga

SEQ ID NO: 94 - DNA, 3771 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtga

SEQ ID NO: 95 - protein, 1252 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 96 - protein, 1151 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 97 - DNA, 3759 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaacctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttga

SEQ ID NO: 98 - DNA, 3456 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaacctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtga

SEQ ID NO: 99 - protein, 1243 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 100 - protein, 1142 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 101 - DNA, 3732 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaagctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttga

SEQ ID NO: 102 - DNA, 3429 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaagctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtga

SEQ ID NO: 103 - protein, 1250 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 104 - protein, 1149 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 105 - DNA, 3753 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataaccccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttga

SEQ ID NO: 106 - DNA, 3450 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataaccccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtga

SEQ ID NO: 107 - protein, 1034 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 108 - protein, 933 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 109 - DNA, 3105 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaacccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttga

SEQ ID NO: 110 - DNA, 2802 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaacccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtga

SEQ ID NO: 111 - protein, 1308 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTALGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 112 - protein, 1106 aa, Artificial Sequence
  Synthetic
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKLGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 113 - DNA, 2715 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttga

SEQ ID NO: 114 - DNA, 2412 bp, Artificial Sequence
  Synthetic
atgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtga

SEQ ID NO: 115 - DNA, 584 bp, Artificial Sequence
  Synthetic
gacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagct

SEQ ID NO: 116 - DNA, 4942 bp, Artificial Sequence
  Synthetic
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctgaattcggtaccgcggccgcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctgctagcgtttaaacttaagcttggtaccatgttcctacagtttgctgtctggaagtgtttaccccatgggatcctcattgcctctctcttggtagtcagctggggccagtatgacgatgactggcaatacgaggattgcaaactagctaggggaggaccaccagctactatcgtggccattgatgaagagagtcgaaacggtacaattctggtggataacatgttgattaaggggactgccggaggaccagaccccaccatagagctctctttaaaggacaacgtggactactgggtgttgctggaccccgttaaacagatgcttttcctgaacagtaccggaagagttctggatagagacccaccaatgaacatacactccattgtggtgcaagtccagtgtgtcaacaagaaggttggcacagttatctatcatgaagtacgcatcgtggtgcgagatcggaatgacaactcccccacattcaagcatgaaagctactatgccaccgtgaatgagctcactccagttggcaccacgatattcacggggttctcgggagacaatggagctacagacatagacgatggccctaatggacagatagaatacgtgattcagtacaacccagaagatccgacatccaacgacacctttgaaattccactcatgctgactggcaacgtggtactgaggaaaagactcaactatgaggataagactcgctactatgtcatcatccaagcaaatgaccgtgcacaaaatctgaatgagaggcgaacaaccaccaccaccctcacagtagatgttctagatggagatgacctgggacctatgtttctgccttgtgttcttgtgccaaacacacgtgactgtcgtccactcacctaccaagctgccattcctgaactgaggactccggaagaactgaaccctattttggtgacaccacctatccaagccattgatcaggaccgaaacatccaaccaccatctgatcgacctggcatcctctactccatccttgtcggcacccctgaggattacccccgcttcttccatatgcatcccaggactgcagaactcactctcctggagccagtaaacagagacttccatcaaaaatttgatttggttattaaggctgagcaggacaatggccacccacttcctgcctttgctagtctgcacatcgaaatactagacgaaaacaatcagcctccagtgtttagcaaacgcatctacaaggggatggtggctccagatgcagtcaaggggacaccaatcaccaccgtttatgctgaagatgcggacccacctgggatgcctgcaagtagggtgaggtatcgagtggacgacgtgcagtttccatacccagccagtatttttgatgtagaggaagattctggaagagtagtaacccgcgtcaatcttaatgaagagcctactacgattttcaagctggtggttgtggcttttgatgacggcgaacctgtgatgtccagcagtgccacggtgagaattcttgtcttacatcctggagagatcccacgcttcacccaagaggaatacagacctcctcctgtaagtgagcttgcggccagagggactgtagttggtgtcatttctgctgctgccattaatcagagcatcgtgtactccattgtggcaggaaatgaggaagacaagtttggaatcaacaatgtcactggggtcatctatgtgaattcaccattggattacgagacaaggaccagctatgtgctccgggtacaagcagattctctggaagtggtccttgccaatctccgagtcccttcaaaaagcaatacagctaaggtgtacattgagattcaggatgaaaacgatcaccccccagtgttccagaagaaattctacattggaggtgtgtctgaagacgcaaggatgttcgcatctgtgctcagagtgaaggccaccgacagggacacgggtaattacagtgccatggcctaccggctcatcataccgccgattaaagagggcaaagaggggtttgtggtggaaacatacacaggtctcatcaagacagccatgctcttccacaatatgagaagatcctacttcaagtttcaagtgattgcaactgacgactacgggaaggggttgagcgggaaagcagacgtactggtctccgtggtcaatcaactggatatgcaggtcattgtctccaatgtgccccctacactagtggaaaagaagatagaagaccttacagagattttggatcgctacgttcaggagcaaattcctggtgccaaggttgtggtggagtccataggtgcccgtcgccatggagacgcctactccctagaagactatagcaagtgcgacctgactgtctatgccatcgacccgcagaccaacagagccatcgacagaaatgagctttttaagttcctggacggcaaactgctcgatatcaataaagacttccagccgtattacggggaaggagggcgcattctggagattcggacacctgaggcagtgacgagcatcaagaagcgaggagaaagcttggggtacacagaaggggccttgctggccttggccttcatcatcatcctctgttgcatcccagccatcttggtcgtcttagtaagctaccgacagtttaaagtacgccaggctgagtgcacgaagaccgcaagaattcagtctgctatgcctgcagccaagcctgcagctcctgtaccagctgcgcctgcgccgcccccgcccccgccaccaccaccaccaggagcacatctctatgaagaactgggagagagcgcaatgcataagtatgagatgccccagtatggaagtcgccgtcgactgctgccacctgctggacaggaggaatacggcgaagtcattggtgaagctgaagaggaatatgaagaagaagaggtagagccagagaaagttaaaaaacccaaagttgaaattagagagcctagtgaggaggaggtggtagtcaccgttgagaagccaccagcggctgagcccacatacccaacgtggaagagagccaggatattcccgatgatttttaagaaagtcagaggtctcgctgagaaaagaggcattgaccttgagggcgaggagtggaggaggcgccttgatgaagaagacaaagactatcttcaactgactctagaccaggaggaagctaccgaaagcaccgtggagtcagaggaggagtccagcgactacacagaatacacagaaacggagtccgagttcagcgagtccgagacaactgaagaatcagagtcggagaccccatctgaggaagcggaggagagctctaccccggagtcagaggagtctgagtccactgagtcagagggagagaaagcaagaaaaaacatcgtgctggctagaagaaggcctgtggtcgaggaaatccaggaggtgaaaggtaagagagaggagcccccggtggaagaggaagaagagcccccactagaggaggaagaacgggcagaggaaggagaagaaagcgaagcagctcccatggatgagtccacagacctggaggctcaggatgtcccagaggagggcagtgcagaatcagtctccatggagaggggcgtggaaagtgaggagtcagagtcagaactgagcagcagcagcagtaccagtgagagtctctccggaggcccctggggctttcaggtgccagaatatgacagaaggaaggatgaagagcccaagaaatctccaggcgcaaactccgaaggttacaacacagccctttagctcgagtctagagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggcca

SEQ ID NO: 117 - DNA, 4915 bp, Artificial Sequence
  Synthetic
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctgaattcggtaccgcggccgcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctgctagcgtttaaacttaagcttggtaccatgttcctacagtttgctgtctggaagtgtttaccccatgggatcctcattgcctctctcttggtagtcagctggggccagtatgacgatgactggcaatacgaggattgcaaactagctaggggaggaccaccagctactatcgtggccattgatgaagagagtcgaaacggtacaattctggtggataacatgttgattaaggggactgccggaggaccagaccccaccatagagctctctttaaaggacaacgtggactactgggtgttgctggaccccgttaaacagatgcttttcctgaacagtaccggaagagttctggatagagacccaccaatgaacatacactccattgtggtgcaagtccagtgtgtcaacaagaaggttggcacagttatctatcatgaagtacgcatcgtggtgcgagatcggaatgacaactcccccacattcaagcatgaaagctactatgccaccgtgaatgagctcactccagttggcaccacgatattcacggggttctcgggagacaatggagctacagacatagacgatggccctaatggacagatagaatacgtgattcagtacaacccagaagatccgacatccaacgacacctttgaaattccactcatgctgactggcaacgtggtactgaggaaaagactcaactatgaggataagactcgctactatgtcatcatccaagcaaatgaccgtgcacaaaatctgaatgagaggcgaacaaccaccaccaccctcacagtagatgttctagatggagatgacctgggacctatgtttctgccttgtgttcttgtgccaaacacacgtgactgtcgtccactcacctaccaagctgccattcctgaactgaggactccggaagaactgaaccctattttggtgacaccacctatccaagccattgatcaggaccgaaacatccaaccaccatctgatcgacctggcatcctctactccatccttgtcggcacccctgaggattacccccgcttcttccatatgcatcccaggactgcagaactcactctcctggagccagtaaacagagacttccatcaaaaatttgatttggttattaaggctgagcaggacaatggccacccacttcctgcctttgctagtctgcacatcgaaatactagacgaaaacaatcaggctcccgtgttcgatccctatctgcccaggaacctctctgtggtggaggaagaagccaatgcctttgtgggtcaagtccgggcaacagacccagatgctgggataaacggccaagttcactacagcctggggaacttcaacaacctcttccgcatcacatccaacgggagcatttacacagccgtgaagctgaacagggaagccagggaccactatgaactggttgtcgtggcaacagatggagcagtccaccctcgacattcaactctgacactgtacatcaaggtgttggacattgatgataacagtcctgtttttaccaattcaacgtacacagttgtcgttgaagagaatctgccagccgggacctcctttcttcaaatagaggccaaggatgttgaccttggagccaatgtgtcatatcggatcagaagcccagaagtgaaacacctttttgcactgcatccattcactggagaattgtctcttctgaggagtttggattatgaggcctttccggaccaggaggcaagcatcacattcttggtggaggcctttgacatttatgggactatgccacctggtatagcaacagtcacggtaattgtgaaggacatgaatgactaccccccagtgttccagaagaaattctacattggaggtgtgtctgaagacgcaaggatgttcgcatctgtgctcagagtgaaggccaccgacagggacacgggtaattacagtgccatggcctaccggctcatcataccgccgattaaagagggcaaagaggggtttgtggtggaaacatacacaggtctcatcaagacagccatgctcttccacaatatgagaagatcctacttcaagtttcaagtgattgcaactgacgactacgggaaggggttgagcgggaaagcagacgtactggtctccgtggtcaatcaactggatatgcaggtcattgtctccaatgtgccccctacactagtggaaaagaagatagaagaccttacagagattttggatcgctacgttcaggagcaaattcctggtgccaaggttgtggtggagtccataggtgcccgtcgccatggagacgcctactccctagaagactatagcaagtgcgacctgactgtctatgccatcgacccgcagaccaacagagccatcgacagaaatgagctttttaagttcctggacggcaaactgctcgatatcaataaagacttccagccgtattacggggaaggagggcgcattctggagattcggacacctgaggcagtgacgagcatcaagaagcgaggagaaagcttggggtacacagaaggggccttgctggccttggccttcatcatcatcctctgttgcatcccagccatcttggtcgtcttagtaagctaccgacagtttaaagtacgccaggctgagtgcacgaagaccgcaagaattcagtctgctatgcctgcagccaagcctgcagctcctgtaccagctgcgcctgcgccgcccccgcccccgccaccaccaccaccaggagcacatctctatgaagaactgggagagagcgcaatgcataagtatgagatgccccagtatggaagtcgccgtcgactgctgccacctgctggacaggaggaatacggcgaagtcattggtgaagctgaagaggaatatgaagaagaagaggtagagccagagaaagttaaaaaacccaaagttgaaattagagagcctagtgaggaggaggtggtagtcaccgttgagaagccaccagcggctgagcccacatacccaacgtggaagagagccaggatattcccgatgatttttaagaaagtcagaggtctcgctgagaaaagaggcattgaccttgagggcgaggagtggaggaggcgccttgatgaagaagacaaagactatcttcaactgactctagaccaggaggaagctaccgaaagcaccgtggagtcagaggaggagtccagcgactacacagaatacacagaaacggagtccgagttcagcgagtccgagacaactgaagaatcagagtcggagaccccatctgaggaagcggaggagagctctaccccggagtcagaggagtctgagtccactgagtcagagggagagaaagcaagaaaaaacatcgtgctggctagaagaaggcctgtggtcgaggaaatccaggaggtgaaaggtaagagagaggagcccccggtggaagaggaagaagagcccccactagaggaggaagaacgggcagaggaaggagaagaaagcgaagcagctcccatggatgagtccacagacctggaggctcaggatgtcccagaggagggcagtgcagaatcagtctccatggagaggggcgtggaaagtgaggagtcagagtcagaactgagcagcagcagcagtaccagtgagagtctctccggaggcccctggggctttcaggtgccagaatatgacagaaggaaggatgaagagcccaagaaatctccaggcgcaaactccgaaggttacaacacagccctttagctcgagtctagagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggcca

SEQ ID NO: 118 - DNA, 4936 bp, Artificial Sequence
  Synthetic
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctgaattcggtaccgcggccgcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctgctagcgtttaaacttaagcttggtaccatgttcctacagtttgctgtctggaagtgtttaccccatgggatcctcattgcctctctcttggtagtcagctggggccagtatgacgatgactggcaatacgaggattgcaaactagctaggggaggaccaccagctactatcgtggccattgatgaagagagtcgaaacggtacaattctggtggataacatgttgattaaggggactgccggaggaccagaccccaccatagagctctctttaaaggacaacgtggactactgggtgttgctggaccccgttaaacagatgcttttcctgaacagtaccggaagagttctggatagagacccaccaatgaacatacactccattgtggtgcaagtccagtgtgtcaacaagaaggttggcacagttatctatcatgaagtacgcatcgtggtgcgagatcggaatgacaactcccccacattcaagcatgaaagctactatgccaccgtgaatgagctcactccagttggcaccacgatattcacggggttctcgggagacaatggagctacagacatagacgatggccctaatggacagatagaatacgtgattcagtacaacccagaagatccgacatccaacgacacctttgaaattccactcatgctgactggcaacgtggtactgaggaaaagactcaactatgaggataagactcgctactatgtcatcatccaagcaaatgaccgtgcacaaaatctgaatgagaggcgaacaaccaccaccaccctcacagtagatgttctagatggagatgacctgggacctatgtttctgccttgtgttcttgtgccaaacacacgtgactgtcgtccactcacctaccaagctgccattcctgaactgaggactccggaagaactgaaccctattttggtgacaccacctatccaagccattgatcaggaccgaaacatccaaccaccatctgatcgacctggcatcctctactccatccttgtcggcacccctgaggattacccccgcttcttccatatgcatcccaggactgcagaactcactctcctggagccagtaaacagagacttccatcaaaaatttgatttggttattaaggctgagcaggacaatggccacccacttcctgcctttgctagtctgcacatcgaaatactagacgaaaacaatcagagtccatacttcacaatgcccagctatcaaggatacatcctggaatccgccccagtgggagccaccatttctgagagcctaaacttaaccactcctctgagaattgtagctctggacaaagacatagaagacacaaaagatccagagctccacctcttcctgaatgactacacctcggtcttcactgtgacacccactggtatcacccgctacctcaccctgcttcaacctgtggacagggaggaacagcaaacctacacctttctgataacagcgtttgatggcgtgcaagaaagtgagccagtcgtggtcaatatccgagtgatggatgcaaatgataacgctcccgtgttcgatccctatctgcccaggaacctctctgtggtggaggaagaagccaatgcctttgtgggtcaagtccgggcaacagacccagatgctgggataaacggccaagttcactacagcctggggaacttcaacaacctcttccgcatcacatccaacgggagcatttacacagccgtgaagctgaacagggaagccagggaccactatgaactggttgtcgtggcaacagatggagcagtccaccctcgacattcaactctgacactgtacatcaaggtgttggacattgatgataaccccccagtgttccagaagaaattctacattggaggtgtgtctgaagacgcaaggatgttcgcatctgtgctcagagtgaaggccaccgacagggacacgggtaattacagtgccatggcctaccggctcatcataccgccgattaaagagggcaaagaggggtttgtggtggaaacatacacaggtctcatcaagacagccatgctcttccacaatatgagaagatcctacttcaagtttcaagtgattgcaactgacgactacgggaaggggttgagcgggaaagcagacgtactggtctccgtggtcaatcaactggatatgcaggtcattgtctccaatgtgccccctacactagtggaaaagaagatagaagaccttacagagattttggatcgctacgttcaggagcaaattcctggtgccaaggttgtggtggagtccataggtgcccgtcgccatggagacgcctactccctagaagactatagcaagtgcgacctgactgtctatgccatcgacccgcagaccaacagagccatcgacagaaatgagctttttaagttcctggacggcaaactgctcgatatcaataaagacttccagccgtattacggggaaggagggcgcattctggagattcggacacctgaggcagtgacgagcatcaagaagcgaggagaaagcttggggtacacagaaggggccttgctggccttggccttcatcatcatcctctgttgcatcccagccatcttggtcgtcttagtaagctaccgacagtttaaagtacgccaggctgagtgcacgaagaccgcaagaattcagtctgctatgcctgcagccaagcctgcagctcctgtaccagctgcgcctgcgccgcccccgcccccgccaccaccaccaccaggagcacatctctatgaagaactgggagagagcgcaatgcataagtatgagatgccccagtatggaagtcgccgtcgactgctgccacctgctggacaggaggaatacggcgaagtcattggtgaagctgaagaggaatatgaagaagaagaggtagagccagagaaagttaaaaaacccaaagttgaaattagagagcctagtgaggaggaggtggtagtcaccgttgagaagccaccagcggctgagcccacatacccaacgtggaagagagccaggatattcccgatgatttttaagaaagtcagaggtctcgctgagaaaagaggcattgaccttgagggcgaggagtggaggaggcgccttgatgaagaagacaaagactatcttcaactgactctagaccaggaggaagctaccgaaagcaccgtggagtcagaggaggagtccagcgactacacagaatacacagaaacggagtccgagttcagcgagtccgagacaactgaagaatcagagtcggagaccccatctgaggaagcggaggagagctctaccccggagtcagaggagtctgagtccactgagtcagagggagagaaagcaagaaaaaacatcgtgctggctagaagaaggcctgtggtcgaggaaatccaggaggtgaaaggtaagagagaggagcccccggtggaagaggaagaagagcccccactagaggaggaagaacgggcagaggaaggagaagaaagcgaagcagctcccatggatgagtccacagacctggaggctcaggatgtcccagaggagggcagtgcagaatcagtctccatggagaggggcgtggaaagtgaggagtcagagtcagaactgagcagcagcagcagtaccagtgagagtctctccggaggcccctggggctttcaggtgccagaatatgacagaaggaaggatgaagagcccaagaaatctccaggcgcaaactccgaaggttacaacacagccctttagctcgagtctagagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggcca

SEQ ID NO: 119 - protein, 121 aa, Homo sapiens
SPYFTMPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDN

SEQ ID NO: 120 - DNA, 363 bp, Homo sapiens
agtccatattttacaatgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataac

SEQ ID NO: 121 - protein, 5 aa, Artificial Sequence
  Synthetic
DENNQ

SEQ ID NO: 122 - protein, 5 aa, Artificial Sequence
  Synthetic
DANDN

SEQ ID NO: 123 - protein, 5 aa, Artificial Sequence
  Synthetic
DVNDN

SEQ ID NO: 124 - protein, 5 aa, Artificial Sequence
  Synthetic
DMNDY

SEQ ID NO: 125 - protein, 5 aa, Artificial Sequence
  Synthetic
DIDDN

SEQ ID NO: 126 - protein, 5 aa, Artificial Sequence
  Synthetic
DENNH

SEQ ID NO: 127 - protein, 5 aa, Artificial Sequence
  Synthetic
DGDDL

SEQ ID NO: 128 - protein, 5 aa, Artificial Sequence
  Synthetic
  misc_feature (2)..(2): Xaa can be any naturally occurring amino acid
DXNDQ

SEQ ID NO: 129 - protein, 5 aa, Artificial Sequence
  Synthetic
  misc_feature (2)..(2): Xaa can be any naturally occurring amino acid
DXNNQ

SEQ ID NO: 130 - protein, 5 aa, Artificial Sequence
  Synthetic
  misc_feature (2)..(2): Xaa can be any naturally occurring amino acid
DXNDN

SEQ ID NO: 131 - protein, 5 aa, Artificial Sequence
  Synthetic
  misc_feature (2)..(2): Xaa can be any naturally occurring amino acid
DXNDY

SEQ ID NO: 132 - protein, 5 aa, Artificial Sequence
  Synthetic
  misc_feature (2)..(2): Xaa can be any naturally occurring amino acid
DXDDN

SEQ ID NO: 133 - protein, 5 aa, Artificial Sequence
  Synthetic
  misc_feature (2)..(2): Xaa can be any naturally occurring amino acid
DXNNN

SEQ ID NO: 134 - protein, 5 aa, Artificial Sequence
  Synthetic
  misc_feature (2)..(2): Xaa can be any naturally occurring amino acid
DXNNH

SEQ ID NO: 135 - protein, 5 aa, Artificial Sequence
  Synthetic
  misc_feature (2)..(2): Xaa can be any naturally occurring amino acid
DXDNH

SEQ ID NO: 136 - protein, 5 aa, Artificial Sequence
  Synthetic
  misc_feature (2)..(2): Xaa can be any naturally occurring amino acid
DXNNY

SEQ ID NO: 137 - protein, 5 aa, Artificial Sequence
  Synthetic
  misc_feature (2)..(2): Xaa can be any naturally occurring amino acid
DXNNL

SEQ ID NO: 138 - protein, 5 aa, Artificial Sequence
  Synthetic
  misc_feature (2)..(2): Xaa can be any naturally occurring amino acid
DXNDL

SEQ ID NO: 139 - protein, 7 aa, Artificial Sequence
  Synthetic
GGGSGGG

SEQ ID NO: 140 - protein, 5 aa, Artificial Sequence
  Synthetic
GGSGG

SEQ ID NO: 141 - protein, 5 aa, Artificial Sequence
  Synthetic
DGNDN

SEQ ID NO: 142 - protein, 5 aa, Artificial Sequence
  Synthetic
DGNNN

SEQ ID NO: 143 - protein, 5 aa, Artificial Sequence
  Synthetic
DANNN

SEQ ID NO: 144 - protein, 5 aa, Artificial Sequence
  Synthetic
GGNDN

SEQ ID NO: 145 - protein, 5 aa, Artificial Sequence
  Synthetic
GGNNN

SEQ ID NO: 146 - protein, 5 aa, Artificial Sequence
  Synthetic
GGSNN

SEQ ID NO: 147 - protein, 5 aa, Artificial Sequence
  Synthetic
GGSAA

SEQ ID NO: 148 - protein, 5 aa, Artificial Sequence
  Synthetic
AANDN

SEQ ID NO: 149 - protein, 5 aa, Artificial Sequence
  Synthetic
AANNN

SEQ ID NO: 150 - DNA, 4380 bp, Mus musculus
aagggctgtgttgtaaccttcggagtttgcgcctggagatttcttgggctcttcatccttccttctgtcatattctggcacctgaaagccccaggggcctccggagagactctcactggtactgctgctgctgctcagttctgactctgactcctcactttccacgcccctctccatggagactgattctgcactgccctcctctgggacatcctgagcctccaggtctgtggactcatccatgggagctgcttcgctttcttctccttcctctgcccgttcttcctcctctagtgggggctcttcttcctcttccaccgggggctcctctctcttacctttcacctcctggatttcctcgaccacaggccttcttctagccagcacgatgttttttcttgctttctctccctctgactcagtggactcagactcctctgactccggggtagagctctcctccgcttcctcagatggggtctccgactctgattcttcagttgtctcggactcgctgaactcggactccgtttctgtgtattctgtgtagtcgctggactcctcctctgactccacggtgctttcggtagcttcctcctggtctagagtcagttgaagatagtctttgtcttcttcatcaaggcgcctcctccactcctcgccctcaaggtcaatgcctcttttctcagcgagacctctgactttcttaaaaatcatcgggaatatcctggctctcttccacgttgggtatgtgggctcagccgctggtggcttctcaacggtgactaccacctcctcctcactaggctctctaatttcaactttgggttttttaactttctctggctctacctcttcttcttcatattcctcttcagcttcaccaatgacttcgccgtattcctcctgtccagcaggtggcagcagtcgacggcgacttccatactggggcatctcatacttatgcattgcgctctctcccagttcttcatagagatgtgctcctggtggtggtggtggcgggggcgggggcggcgcaggcgcagctggtacaggagctgcaggcttggctgcaggcatagcagactgaattcttgcggtcttcgtgcactcagcctggcgtactttaaactgtcggtagcttactaagacgaccaagatggctgggatgcaacagaggatgatgatgaaggccaaggccagcaaggccccttctgtgtaccccaagctttctcctcgcttcttgatgctcgtcactgcctcaggtgtccgaatctccagaatgcgccctccttccccgtaatacggctggaagtctttattgatatcgagcagtttgccgtccaggaacttaaaaagctcatttctgtcgatggctctgttggtctgcgggtcgatggcatagacagtcaggtcgcacttgctatagtcttctagggagtaggcgtctccatggcgacgggcacctatggactccaccacaaccttggcaccaggaatttgctcctgaacgtagcgatccaaaatctctgtaaggtcttctatcttcttttccactagtgtagggggcacattggagacaatgacctgcatatccagttgattgaccacggagaccagtacgtctgctttcccgctcaaccccttcccgtagtcgtcagttgcaatcacttgaaacttgaagtaggatcttctcatattgtggaagagcatggctgtcttgatgagacctgtgtatgtttccaccacaaacccctctttgccctctttaatcggcggtatgatgagccggtaggccatggcactgtaattacccgtgtccctgtcggtggccttcactctgagcacagatgcgaacatccttgcgtcttcagacacacctccaatgtagaatttcttctggaacactggggggtgatcgttttcatcctgaatctcaatgtacaccttagctgtattgctttttgaagggactcggagattggcaaggaccacttccagagaatctgcttgtacccggagcacatagctggtccttgtctcgtaatccaatggtgaattcacatagatgaccccagtgacattgttgattccaaacttgtcttcctcatttcctgccacaatggagtacacgatgctctgattaatggcagcagcagaaatgacaccaactacagtccctctggccgcaagctcacttacaggaggaggtctgtattcctcttgggtgaagcgtgggatctctccaggatgtaagacaagaattctcaccgtggcactgctggacatcacaggttcgccgtcatcaaaagccacaaccaccagcttgaaaatcgtagtaggctcttcattaagattgacgcgggttactactcttccagaatcttcctctacatcaaaaatactggctgggtatggaaactgcacgtcgtccactcgatacctcaccctacttgcaggcatcccaggtgggtccgcatcttcagcataaacggtggtgattggtgtccccttgactgcatctggagccaccatccccttgtagatgcgtttgctaaacactggagggttgtcattgacgtccgtcaccactatgttcacagtggcagttgaggttccatccggtctgccatctgaggctgtgacgatgaggatgtagcggtctgtgctctcgcggtctagagccttccctaggctgagaatccctgtggtttctgaaagattaaaaactctctgagggtctccattctcgatggcatatgtgattggatctccctctcgatcagttgcctgtagatttaataaaatagcaccgatcctcatggcctcgctgacttccagactgtacatcagctgcgggaagcggggagggctctggttgttaggaggaagcacctcgatgtacactgtgcagatggagtgccttctttctgcaggcggggcgttgtccgaagcctgcactgtgagcgcatacgtctgtcccacgatcagctccacgcctggtgcaatgctcaccagccctgtggtcttgttgatcacgaagtctcccttgccccccaccagtatttcataggagatctccccattagagccttcatcagcatctaccgctgtcagctgaatgacgctgtccccaggactcatgtctgtgtaaacatagacatcataggagatttcagggaaggtgggcgtctgattgttttcgtctagtatttcgatgtgcagactagcaaaggcaggaagtgggtggccattgtcctgctcagccttaataaccaaatcaaatttttgatggaagtctctgtttactggctccaggagagtgagttctgcagtcctgggatgcatatggaagaagcgggggtaatcctcaggggtgccgacaaggatggagtagaggatgccaggtcgatcagatggtggttggatgtttcggtcctgatcaatggcttggataggtggtgtcaccaaaatagggttcagttcttccggagtcctcagttcaggaatggcagcttggtaggtgagtggacgacagtcacgtgtgtttggcacaagaacacaaggcagaaacataggtcccaggtcatctccatctagaacatctactgtgagggtggtggtggttgttcgcctctcattcagattttgtgcacggtcatttgcttggatgatgacatagtagcgagtcttatcctcatagttgagtcttttcctcagtaccacgttgccagtcagcatgagtggaatttcaaaggtgtcgttggatgtcggatcttctgggttgtactgaatcacgtattctatctgtccattagggccatcgtctatgtctgtagctccattgtctcccgagaaccccgtgaatatcgtggtgccaactggagtgagctcattcacggtggcatagtagctttcatgcttgaatgtgggggagttgtcattccgatctcgcaccacgatgcgtacttcatgatagataactgtgccaaccttcttgttgacacactggacttgcaccacaatggagtgtatgttcattggtgggtctctatccagaactcttccggtactgttcaggaaaagcatctgtttaacggggtccagcaacacccagtagtccacgttgtcctttaaagagagctctatggtggggtctggtcctccggcagtccccttaatcaacatgttatccaccagaattgtaccgtttcgactctcttcatcaatggccacgatagtagctggtggtcctcccctagctagtttgcaatcctcgtattgccagtcatcgtcatactggccccagctgactaccaagagagaggcaatgaggatcccatggggtaaacacttccagacagcaaactgtaggaacat

SEQ ID NO: 151 - DNA, 4419 bp, Mus musculus
aagggctgtgttgtaaccttcggagtttgcgcctggagatttcttgggctcttcatccttccttctgtcatattctggcacctgaaagccccaggggcctccggagagactctcactggtactgctgctgctgctcagttctgactctgactcctcactttccacgcccctctccatggagactgattctgcactgccctcctctgggacatcctgagcctccaggtctgtggactcatccatgggagctgcttcgctttcttctccttcctctgcccgttcttcctcctctagtgggggctcttcttcctcttccaccgggggctcctctctcttacctttcacctcctggatttcctcgaccacaggccttcttctagccagcacgatgttttttcttgctttctctccctctgactcagtggactcagactcctctgactccggggtagagctctcctccgcttcctcagatggggtctccgactctgattcttcagttgtctcggactcgctgaactcggactccgtttctgtgtattctgtgtagtcgctggactcctcctctgactccacggtgctttcggtagcttcctcctggtctagagtcagttgaagatagtctttgtcttcttcatcaaggcgcctcctccactcctcgccctcaaggtcaatgcctcttttctcagcgagacctctgactttcttaaaaatcatcgggaatatcctggctctcttccacgttgggtatgtgggctcagccgctggtggcttctcaacggtgactaccacctcctcctcactaggctctctaatttcaactttgggttttttaactttctctggctctacctcttcttcttcatattcctcttcagcttcaccaatgacttcgccgtattcctcctgtccagcaggtggcagcagtcgacggcgacttccatactggggcatctcatacttatgcattgcgctctctcccagttcttcatagagatgtgctcctggtggtggtggtggcgggggcgggggcggcgcaggcgcagctggtacaggagctgcaggcttggctgcaggcatagcagactgaattcttgcggtcttcgtgcactcagcctggcgtactttaaactgtcggtagcttactaagacgaccaagatggctgggatgcaacagaggatgatgatgaaggccaaggccagcaaggccccttctgtgtaccccaagctttctcctcgcttcttgatgctcgtcactgcctcaggtgtccgaatctccagaatgcgccctccttccccgtaatacggctggaagtctttattgatatcgagcagtttgccgtccaggaacttaaaaagctcatttctgtcgatggctctgttggtctgcgggtcgatggcatagacagtcaggtcgcacttgctatagtcttctagggagtaggcgtctccatggcgacgggcacctatggactccaccacaaccttggcaccaggaatttgctcctgaacgtagcgatccaaaatctctgtaaggtcttctatcttcttttccactagtgtagggggcacattggagacaatgacctgcatatccagttgattgaccacggagaccagtacgtctgctttcccgctcaaccccttcccgtagtcgtcagttgcaatcacttgaaacttgaagtaggatcttctcatattgtggaagagcatggctgtcttgatgagacctgtgtatgtttccaccacaaacccctctttgccctctttaatcggcggtatgatgagccggtaggccatggcactgtaattacccgtgtccctgtcggtggccttcactctgagcacagatgcgaacatccttgcgtcttcagacacacctccaatgtagaatttcttctggaacactggggggtgatcgttttcatcctgaatctcaatgtacaccttagctgtattgctttttgaagggactcggagattggcaaggaccacttccagagaatctgcttgtacccggagcacatagctggtccttgtctcgtaatccaatggtgaattcacatagatgaccccagtgacattgttgattccaaacttgtcttcctcatttcctgccacaatggagtacacgatgctctgattaatggcagcagcagaaatgacaccaactacagtccctctggccgcaagctcacttacaggaggaggtctgtattcctcttgggtgaagcgtgggatctctccaggatgtaagacaagaattctcaccgtggcactgctggacatcacaggttcgccgtcatcaaaagccacaaccaccagcttgaaaatcgtagtaggctcttcattaagattgacgcgggttactactcttccagaatcttcctctacatcaaaaatactggctgggtatggaaactgcacgtcgtccactcgatacctcaccctacttgcaggcatcccaggtgggtccgcatcttcagcataaacggtggtgattggtgtccccttgactgcatctggagccaccatccccttgtagatgcgtttgctaaacactggagggtagtcattcatgtccttcacaattaccgtgactgttgctataccaggtggcatagtcccataaatgtcaaaggcctccaccaagaatgtgatgcttgcctcctggtccggaaaggcctcataatccaaactcctcagaagagacaattctccagtgaatggatgcagtgcaaaaaggtgtttcacttctgggcttctgatccgatatgacacattggctccaaggtcaacatccttggcctctatttgaagaaaggaggtcccggctggcagattctcttcaacgacaactgtgtacgttgaattggtaaaaacaggactgttatcatttgcatccatcactcggatattgaccacgactggctcactttcttgcacgccatcaaacgctgttatcagaaaggtgtaggtttgctgttcctccctgtccacaggttgaagcagggtgaggtagcgggtgataccagtgggtgtcacagtgaagaccgaggtgtagtcattcaggaagaggtggagctctggatcttttgtgtcttctatgtctttgtccagagctacaattctcagaggagtggttaagtttaggctctcagaaatggtggctcccactggggcggattccaggatgtatccttgatagctgggcattgtgaagtatggactctgattgttttcgtctagtatttcgatgtgcagactagcaaaggcaggaagtgggtggccattgtcctgctcagccttaataaccaaatcaaatttttgatggaagtctctgtttactggctccaggagagtgagttctgcagtcctgggatgcatatggaagaagcgggggtaatcctcaggggtgccgacaaggatggagtagaggatgccaggtcgatcagatggtggttggatgtttcggtcctgatcaatggcttggataggtggtgtcaccaaaatagggttcagttcttccggagtcctcagttcaggaatggcagcttggtaggtgagtggacgacagtcacgtgtgtttggcacaagaacacaaggcagaaacataggtcccaggtcatctccatctagaacatctactgtgagggtggtggtggttgttcgcctctcattcagattttgtgcacggtcatttgcttggatgatgacatagtagcgagtcttatcctcatagttgagtcttttcctcagtaccacgttgccagtcagcatgagtggaatttcaaaggtgtcgttggatgtcggatcttctgggttgtactgaatcacgtattctatctgtccattagggccatcgtctatgtctgtagctccattgtctcccgagaaccccgtgaatatcgtggtgccaactggagtgagctcattcacggtggcatagtagctttcatgcttgaatgtgggggagttgtcattccgatctcgcaccacgatgcgtacttcatgatagataactgtgccaaccttcttgttgacacactggacttgcaccacaatggagtgtatgttcattggtgggtctctatccagaactcttccggtactgttcaggaaaagcatctgtttaacggggtccagcaacacccagtagtccacgttgtcctttaaagagagctctatggtggggtctggtcctccggcagtccccttaatcaacatgttatccaccagaattgtaccgtttcgactctcttcatcaatggccacgatagtagctggtggtcctcccctagctagtttgcaatcctcgtattgccagtcatcgtcatactggccccagctgactaccaagagagaggcaatgaggatcccatggggtaaacacttccagacagcaaactgtaggaacat

SEQ ID NO: 152 - DNA, 3102 bp, Mus musculus
atgttcctacagtttgctgtctggaagtgtttaccccatgggatcctcattgcctctctcttggtagtcagctggggccagtatgacgatgactggcaatacgaggattgcaaactagctaggggaggaccaccagctactatcgtggccattgatgaagagagtcgaaacggtacaattctggtggataacatgttgattaaggggactgccggaggaccagaccccaccatagagctctctttaaaggacaacgtggactactgggtgttgctggaccccgttaaacagatgcttttcctgaacagtaccggaagagttctggatagagacccaccaatgaacatacactccattgtggtgcaagtccagtgtgtcaacaagaaggttggcacagttatctatcatgaagtacgcatcgtggtgcgagatcggaatgacaactcccccacattcaagcatgaaagctactatgccaccgtgaatgagctcactccagttggcaccacgatattcacggggttctcgggagacaatggagctacagacatagacgatggccctaatggacagatagaatacgtgattcagtacaacccagaagatccgacatccaacgacacctttgaaattccactcatgctgactggcaacgtggtactgaggaaaagactcaactatgaggataagactcgctactatgtcatcatccaagcaaatgaccgtgcacaaaatctgaatgagaggcgaacaaccaccaccaccctcacagtagatgttctagatggagatgacctgggacctatgtttctgccttgtgttcttgtgccaaacacacgtgactgtcgtccactcacctaccaagctgccattcctgaactgaggactccggaagaactgaaccctattttggtgacaccacctatccaagccattgatcaggaccgaaacatccaaccaccatctgatcgacctggcatcctctactccatccttgtcggcacccctgaggattacccccgcttcttccatatgcatcccaggactgcagaactcactctcctggagccagtaaacagagacttccatcaaaaatttgatttggttattaaggctgagcaggacaatggccacccacttcctgcctttgctagtctgcacatcgaaatactagacgaaaacaatcagcccccagtgttccagaagaaattctacattggaggtgtgtctgaagacgcaaggatgttcgcatctgtgctcagagtgaaggccaccgacagggacacgggtaattacagtgccatggcctaccggctcatcataccgccgattaaagagggcaaagaggggtttgtggtggaaacatacacaggtctcatcaagacagccatgctcttccacaatatgagaagatcctacttcaagtttcaagtgattgcaactgacgactacgggaaggggttgagcgggaaagcagacgtactggtctccgtggtcaatcaactggatatgcaggtcattgtctccaatgtgccccctacactagtggaaaagaagatagaagaccttacagagattttggatcgctacgttcaggagcaaattcctggtgccaaggttgtggtggagtccataggtgcccgtcgccatggagacgcctactccctagaagactatagcaagtgcgacctgactgtctatgccatcgacccgcagaccaacagagccatcgacagaaatgagctttttaagttcctggacggcaaactgctcgatatcaataaagacttccagccgtattacggggaaggagggcgcattctggagattcggacacctgaggcagtgacgagcatcaagaagcgaggagaaagcttggggtacacagaaggggccttgctggccttggccttcatcatcatcctctgttgcatcccagccatcttggtcgtcttagtaagctaccgacagtttaaagtacgccaggctgagtgcacgaagaccgcaagaattcagtctgctatgcctgcagccaagcctgcagctcctgtaccagctgcgcctgcgccgcccccgcccccgccaccaccaccaccaggagcacatctctatgaagaactgggagagagcgcaatgcataagtatgagatgccccagtatggaagtcgccgtcgactgctgccacctgctggacaggaggaatacggcgaagtcattggtgaagctgaagaggaatatgaagaagaagaggtagagccagagaaagttaaaaaacccaaagttgaaattagagagcctagtgaggaggaggtggtagtcaccgttgagaagccaccagcggctgagcccacatacccaacgtggaagagagccaggatattcccgatgatttttaagaaagtcagaggtctcgctgagaaaagaggcattgaccttgagggcgaggagtggaggaggcgccttgatgaagaagacaaagactatcttcaactgactctagaccaggaggaagctaccgaaagcaccgtggagtcagaggaggagtccagcgactacacagaatacacagaaacggagtccgagttcagcgagtccgagacaactgaagaatcagagtcggagaccccatctgaggaagcggaggagagctctaccccggagtcagaggagtctgagtccactgagtcagagggagagaaagcaagaaaaaacatcgtgctggctagaagaaggcctgtggtcgaggaaatccaggaggtgaaaggtaagagagaggagcccccggtggaagaggaagaagagcccccactagaggaggaagaacgggcagaggaaggagaagaaagcgaagcagctcccatggatgagtccacagacctggaggctcaggatgtcccagaggagggcagtgcagaatcagtctccatggagaggggcgtggaaagtgaggagtcagagtcagaactgagcagcagcagcagtaccagtgagagtctctccggaggcccctggggctttcaggtgccagaatatgacagaaggaaggatgaagagcccaagaaatctccaggcgcaaactccgaaggttacaacacagccctt

SEQ ID NO: 153 - DNA, 2712 bp, Mus musculus
atgttcctacagtttgctgtctggaagtgtttaccccatgggatcctcattgcctctctcttggtagtcagctggggccagtatgacgatgactggcaatacgaggattgcaaactagctaggggaggaccaccagctactatcgtggccattgatgaagagagtcgaaacggtacaattctggtggataacatgttgattaaggggactgccggaggaccagaccccaccatagagctctctttaaaggacaacgtggactactgggtgttgctggaccccgttaaacagatgcttttcctgaacagtaccggaagagttctggatagagacccaccaatgaacatacactccattgtggtgcaagtccagtgtgtcaacaagaaggttggcacagttatctatcatgaagtacgcatcgtggtgcgagatcggaatgacaactcccccacattcaagcatgaaagctactatgccaccgtgaatgagctcactccagttggcaccacgatattcacggggttctcgggagacaatggagctacagacatagacgatggccctaatggacagatagaatacgtgattcagtacaacccagaagatccgacatccaacgacacctttgaaattccactcatgctgactggcaacgtggtactgaggaaaagactcaactatgaggataagactcgctactatgtcatcatccaagcaaatgaccgtgcacaaaatctgaatgagaggcgaacaaccaccaccaccctcacagtagatgttctagatggagatgacctgcccccagtgttccagaagaaattctacattggaggtgtgtctgaagacgcaaggatgttcgcatctgtgctcagagtgaaggccaccgacagggacacgggtaattacagtgccatggcctaccggctcatcataccgccgattaaagagggcaaagaggggtttgtggtggaaacatacacaggtctcatcaagacagccatgctcttccacaatatgagaagatcctacttcaagtttcaagtgattgcaactgacgactacgggaaggggttgagcgggaaagcagacgtactggtctccgtggtcaatcaactggatatgcaggtcattgtctccaatgtgccccctacactagtggaaaagaagatagaagaccttacagagattttggatcgctacgttcaggagcaaattcctggtgccaaggttgtggtggagtccataggtgcccgtcgccatggagacgcctactccctagaagactatagcaagtgcgacctgactgtctatgccatcgacccgcagaccaacagagccatcgacagaaatgagctttttaagttcctggacggcaaactgctcgatatcaataaagacttccagccgtattacggggaaggagggcgcattctggagattcggacacctgaggcagtgacgagcatcaagaagcgaggagaaagcttggggtacacagaaggggccttgctggccttggccttcatcatcatcctctgttgcatcccagccatcttggtcgtcttagtaagctaccgacagtttaaagtacgccaggctgagtgcacgaagaccgcaagaattcagtctgctatgcctgcagccaagcctgcagctcctgtaccagctgcgcctgcgccgcccccgcccccgccaccaccaccaccaggagcacatctctatgaagaactgggagagagcgcaatgcataagtatgagatgccccagtatggaagtcgccgtcgactgctgccacctgctggacaggaggaatacggcgaagtcattggtgaagctgaagaggaatatgaagaagaagaggtagagccagagaaagttaaaaaacccaaagttgaaattagagagcctagtgaggaggaggtggtagtcaccgttgagaagccaccagcggctgagcccacatacccaacgtggaagagagccaggatattcccgatgatttttaagaaagtcagaggtctcgctgagaaaagaggcattgaccttgagggcgaggagtggaggaggcgccttgatgaagaagacaaagactatcttcaactgactctagaccaggaggaagctaccgaaagcaccgtggagtcagaggaggagtccagcgactacacagaatacacagaaacggagtccgagttcagcgagtccgagacaactgaagaatcagagtcggagaccccatctgaggaagcggaggagagctctaccccggagtcagaggagtctgagtccactgagtcagagggagagaaagcaagaaaaaacatcgtgctggctagaagaaggcctgtggtcgaggaaatccaggaggtgaaaggtaagagagaggagcccccggtggaagaggaagaagagcccccactagaggaggaagaacgggcagaggaaggagaagaaagcgaagcagctcccatggatgagtccacagacctggaggctcaggatgtcccagaggagggcagtgcagaatcagtctccatggagaggggcgtggaaagtgaggagtcagagtcagaactgagcagcagcagcagtaccagtgagagtctctccggaggcccctggggctttcaggtgccagaatatgacagaaggaaggatgaagagcccaagaaatctccaggcgcaaactccgaaggttacaacacagccctt

SEQ ID NO: 154 - DNA, 1695 bp, Artificial Sequence
  Synthetic
ggggccttgctggccttggccttcatcatcatcctctgttgcatcccagccatcttggtcgtcttagtaagctaccgacagtttaaagtacgccaggctgagtgcacgaagaccgcaagaattcagtctgctatgcctgcagccaagcctgcagctcctgtaccagctgcgcctgcgccgcccccgcccccgccaccaccaccaccaggagcacatctctatgaagaactgggagagagcgcaatgcataatcttttccttctctaccattttgaacaaagcaggggaaataactcagtcccagaagacaggagcagtcatcgcgatgggatggccttttcctccagtaccactgagtctcatgagccagctcatgtagagggaccacttaaggagagccagcctaacccagcaaggacgttctcatttgttcctgatgaggataacttaagtacccataatcccctttacatggaaagtataggtcaaaggtcaacaaactcagaccttcagccacgaacagattttgaagagctgttggcacccagaacacaagttaagagtcagtctctgaggggcccaagagaaaagatccagagggtgtggaatcagtctgtgagctttcctaggcggctcatgtggaaagccccaaacaggccagagaccatagacctggtggagtggcagatcaccaatcagagagctgaatgcgaaagcgccagatgccacccaagccagagaggtagcagcaacgttctgctggcaactgaagatgcccacgagtcagagaaagaagggggacacagagacaccctaatcgtccagcaaacagagcagctgaaatctctgtcttctggctcttctttttcctcctcttggtctcacttttctttctcaactctgccaacgatttccagagcggtggaactcgggtcggaacctaatgtggtcacttctcccgctgactgcaccttggaactttctcctcctctgagaccccgtattttaaactccttaagctctaagagagagactcccacatgtgcatcagatacagaaccaaaaaggaactcttttgagatcgctccccatccacctagcatctctgctcccctcccacatccgcctcttcctagacctcccattgcctttaccacttttcctcttcccctttctccccctaaccctcctcccccacaacttgttacattttctcttcccatttctacaccccctacttcttctctacctcttcctcctccactgtcacttcctcctcctcctcggccaccagctccccgcctcttcccacagcctccttccacgtccattccatccacagacagcatctctgcaccagctgctaaatgcactgccagtgccacacacgccagagaaaccacgtctacgacacagccaccagcatccaacccgcagtggggggcagaaccccacagacatccaaaagggatcctcagacatgtgaaaaacttggcagagctcgagaaatcagtgtctaacatgtacagtcacatagaaaaaaactgcccacctgcagatccctcaaaactacacacgttttgccctgcagagaaaacaggcatgaaaatcacacatgaccagagccaggaaacgttggttagagttgttgagggaattgacgtgcaacctcacagtcaatcaacatctttgtaa

SEQ ID NO: 155 - DNA, 1212 bp, Artificial Sequence
  Synthetic
ggggccttgctggccttggccttcatcatcatcctctgttgcatcccagccatcttggtcgtcttagtaagctaccgacagtttaaagtacgccaggctgagtgcacgaagaccgcaagaattcagtctgctatgcctgcagccaagcctgcagctcctgtaccagctgcgcctgcgccgcccccgcccccgccaccaccaccaccaggagcacatctctatgaagaactgggagagagcgcaatgcataagtatgagatgccccagtatggaagtcgccgtcgactgctgccacctgctggacaggaggaatacggcgaagtcattggtgaagctgaagaggaatatgaagaagaagaggtagagccagagaaagttaaaaaacccaaagttgaaattagagagcctagtgaggaggaggtggtagtcaccgttgagaagccaccagcggctgagcccacatacccaacgtggaagagagccaggatattcccgatgatttttaagaaagtcagaggtctcgctgagaaaagaggcattgaccttgagggcgaggagtggaggaggcgccttgatgaagaagacaaagactatcttcaactgactctagaccaggaggaagctaccgaaagcaccgtggagtcagaggaggagtccagcgactacacagaatacacagaaacggagtccgagttcagcgagtccgagacaactgaagaatcagagtcggagaccccatctgaggaagcggaggagagctctaccccggagtcagaggagtctgagtccactgagtcagagggagagaaagcaagaaaaaacatcgtgctggctagaagaaggcctgtggtcgaggaaatccaggaggtgaaaggtaagagagaggagcccccggtggaagaggaagaagagcccccactagaggaggaagaacgggcagaggaaggagaagaaagcgaagcagctcccatggatgagtccacagacctggaggctcaggatgtcccagaggagggcagtgcagaatcagtctccatggagaggggcgtggaaagtgaggagtcagagtcagaactgagcagcagcagcagtaccagtgagagtctctccggaggcccctggggctttcaggtgccagaatatgacagaaggaaggatgaagagcccaagaaatctccaggcgcaaactccgaaggttacaacacagccctt

SEQ ID NO: 156 - DNA, 4592 bp, Artificial Sequence
  Synthetic
ggggccttgctggccttggccttcatcatcatcctctgttgcatcccagccatcttggtcgtcttagtaagctaccgacagtttaaagtacgccaggctgagtgcacgaagaccgcaagaattcagtctgctatgcctgcagccaagcctgcagctcctgtaccagctgcgcctgcgccgcccccgcccccgccaccaccaccaccaggagcacatctctatgaagaactgggagagagcgcaatgcataagtatgagatgccccagtatggaagtcgccgtcgactgctgccacctgctggacaggaggaatacggcgaagtcattggtgaagctgaagaggaatatgaagaagaagagtgggcaagaaaaagaatgatcaagttggtggtcgatcgggagtatgagagcagctcacctggggaagacagcgctcctgagtcgcagagaagcagaactcacaagcccagtggccgcagcaatgtcaacggcaacatctacattgcgcagaatggttccgtggtgagaacacgccgtgcctgcgtcgctgataacttgaaggtgccctcccctgggttgcttgggaggcatctgaagaaattagacacattggcagggacacgtgaagagaatgtgcccctgaacacactgttcaaggggccattttccacagagaaagcgaaaagaaccccaactctggtcacgtttgccccgtgccccgtggtggctgagcactcggcagtgaagccatcagggaccaggctgaaacacacagctgagcaggagtccatggtagacagtaggctctccagagagtcgatggaattccacggtgacagcgcgccatcagatgaggaggagctctggatgggtccgtggaacagcctccacataccaatgacaaaactctgaccaatacaaagaataacttcgtttttacttgtttttaatgaactctgctttttattgtctcaaaaatcaacatatggggtttatcacatgtgcacaacctaacacttcgaatgatctgctttacaataaaagagaaagagagagatcatttgtatcaattaattgttagccccagaaaagcctttgtggacagacagaaatcactaagtaacatcacttcaaagtctagttgtttggttggatcttgaattagtcttttccattgtaataagcaaggaataacttagtagaaatcatttatattttttgcttaacatagattgtactccatttctaggttgacagcacatttttccgcacatgtaattttattttctatggggtaacagatttttataggtatgagatttatacagctactgtctgtactgtgctgactttataaaagaaaaataggcttacaaagcagcagtccaggtgggaatcacttgtaagttattttcaatcctgaagttacatagtatccacaatgtagttttaaagatttttgaaggaatacttgtggccttaggaagaacattcgaggtcaatgcttttataaaaacaaaaaaaaaaaaaaaaaaccaaaaaacaaaaaacacataatttaccgttttacctggcacacaccccacatgtatctgcatatattctatccattccacatggagcaaataatttaccaacttttgcaagtcagtaactgtttgaagcaacatataaaccccactctcaacaaaagcttagtgaggagtagggaggggcaagtggacagcaaagcttctcgaacccatggtcagtggatgacgtagcaaggcggaggagtctcgcctaatgtgactagacaggaatcccttataagcccagcatacaaggatgtgtcggggtcacaggcttatacaatgtgttaacctcctatctatctatccaggctgcaattccacagcttcattgcactggagcacttcatttctcccagctctcatttattgatagatgactttagtgcacatatttatgtgctatggtccagagccagaaaacgattgtctgcacatttgttttaatcaaagaacatgatcttcatttttccacctctgaacagaagacacagtgttttgccattagtagaaactaaacaaaatggcctttaaaaattgccttgtgtgttgcctattctgcagcattagaaaggatgaccaatgtagtctaaggggcttcagaattttattgaatatgtcttagtgtgatatagatatattttgcttcaaatttggcattgtactgagcgagttcatatgtcaattaaattcctttgggcatgtttatcatgtggttgaagaactgaatagcctgttattattactgcctttacgtggttcagattataaaatggtttttacaatgttattttctcatttgcaaggtgaaggaattatatttagcgactcaccaatttctgtgactagtatgttttcatttcagatatgtgaacatacttggaggaatatcctgaaatctcattttactgggaatcaattcctttttatacccttagaaaacccatcagcattagtagtaatgttagaactgtagagtcatgtccacacccacaggcttactaacaaggaggtacgccttcacaatatgtaagatggcttgcatgcatattgaagtttatgaagcaatgtacggccagtccttcaggcaccaaagcaatttttttgttacataaaatatttcatatagatctcaaattaagcattcatacttccctactagctcagtcattgatcactaaatataatttaatattttatgacatttcatggtaatgattactaggctcccttggtattctttgtacatacagatctgtattttttgcccttcctttagcttctagatgtaaatgttaacttatatgttgctgttcctctcacagttgggttttttttcctttcagccaaggtttctatgttctggtaaggaagtttgttttgattattgctattgaaaaaaaaacttaagatgggggtaagataggagaacttcataaaaagctgtgtggatcttggaaaatttctgtggccactgttaatatatgagcagagttccaaaggctagtgtcataacatgatagaaaacatggtattttcaagatcacacactgtaagacaatatgcagctattaaaacccagggggccattccgatttcagcacttataagatgatcgttctgatataaatgatcctgaagctaatctattcctggggtgagataaagatgagcagccttgatggggaacaaccaaatcaaatatttggtttgtgtatttgaaggaaagagacagccctaaaacgctggctgaataaatctggattagctgaagcactacactcacaggactttaaataacccatgaaatctggactcatgattaaaactgcaaagcacaggggaaatatgtaggtactgttagtcttaaaaagaattaacatagatagtatttacatggaagtatatataaggaaatttgtgcctggttttcctagaagggcatgagaagtttctttagcttttgttcttaataaataccagccttcactaaggggaaataaagcaaacaaataaaccctgccgttcctaatgaaccaacatacacagcaaataccatcacagtcctgttgtaacctgagatttccgaagccttgtggacactaaattcaaggaagaagcagagcagtcagtgtggcaaggtactggtcaccctgtgaccattagcccatggtgtcctccaagtgtctagatttattcttctcattgactgaaaaccctaagagctgtcacagaattccaactgaatagcatcccaaaggaccttcttaaagtacaggaaacggctgtcctgaggtccccactgtcagcaatgatgttaaaacatgtttgccctctgtgggtcttccaaacagtcactgcagctacaatcaaaatgttgctgataacacttatgtatcagaaagcaagaagtcattggatattaattcatgaaaggagccatcgtctttcttcctttcacagatcttctttaatctctcattctgttttattcattcattgccttatactatacacagtaagtagaacttccacagtcctttagttcaatggtgagatgggcagaaagcactaagactctattctcaggacagatgcctcctgtgcctgtaaatgccacagtggtgcatctgaagggtaagttcaaatagtatctaggactctatttcctatagaaagtttctccctattccagggtgataacatgaatttcttgttgtatttctctcttgttttagcagtagctgattctgtttactttggttttttttccattgaagtcttaagtttatggcaagttaatcacgtgtatgaaaaatgtgaacgttgtctatagtttgagaaattatcaggacatccacattttcccaatttctttaccgaaatgactgttcttccttaaatgttacgttaaggtatgaagaaaatcaagtataaagtctgggttaaaatacattgttatacaattacacaatgttttacaaataaatttctttttgaaaaaaaaaaaaaaaaaaaaaa

SEQ ID NO: 157 - protein, 1782 aa, Artificial Sequence
  Synthetic
MKRTADGSEFESPKKKRKVSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 158 - DNA, 5346 bp, Artificial Sequence
  Synthetic
atgaaacggacagccgacggaagcgagttcgagtcaccaaagaagaagcggaaagtctctgaagtcgagtttagccacgagtattggatgaggcacgcactgaccctggcaaagcgagcatgggatgaaagagaagtccccgtgggcgccgtgctggtgcacaacaatagagtgatcggagagggatggaacaggccaatcggccgccacgaccctaccgcacacgcagagatcatggcactgaggcagggaggcctggtcatgcagaattaccgcctgatcgatgccaccctgtatgtgacactggagccatgcgtgatgtgcgcaggagcaatgatccacagcaggatcggaagagtggtgttcggagcacgggacgccaagaccggcgcagcaggctccctgatggatgtgctgcaccaccccggcatgaaccaccgggtggagatcacagagggaatcctggcagacgagtgcgccgccctgctgagcgatttctttagaatgcggagacaggagatcaaggcccagaagaaggcacagagctccaccgactctggaggatctagcggaggatcctctggaagcgagacaccaggcacaagcgagtccgccacaccagagagctccggcggctcctccggaggatcctctgaggtggagttttcccacgagtactggatgagacatgccctgaccctggccaagagggcacgcgatgagagggaggtgcctgtgggagccgtgctggtgctgaacaatagagtgatcggcgagggctggaacagagccatcggcctgcacgacccaacagcccatgccgaaattatggccctgagacagggcggcctggtcatgcagaactacagactgattgacgccaccctgtacgtgacattcgagccttgcgtgatgtgcgccggcgccatgatccactctaggatcggccgcgtggtgtttggcgtgaggaacgcaaaaaccggcgccgcaggctccctgatggacgtgctgcactaccccggcatgaatcaccgcgtcgaaattaccgagggaatcctggcagatgaatgtgccgccctgctgtgctatttctttcggatgcctagacaggtgttcaatgctcagaagaaggcccagagctccaccgactccggaggatctagcggaggctcctctggctctgagacacctggcacaagcgagagcgcaacacctgaaagcagcgggggcagcagcggggggtcagacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 159 - protein, 1764 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 160 - DNA, 5291 bp, Artificial Sequence
  Synthetic
atgtccgaagtcgagttttcccatgagtactggatgagacacgcattgactctcgcaaagagggcttgggatgaacgcgaggtgcccgtgggggcagtactcgtgcataacaatcgcgtaatcggcgaaggttggaataggccgatcggacgccacgaccccactgcacatgcggaaatcatggcccttcgacagggagggcttgtgatgcagaattatcgacttatcgatgcgacgctgtacgtcacgcttgaaccttgcgtaatgtgcgcgggagctatgattcactcccgcattggacgagttgtattcggtgcccgcgacgccaagacgggtgccgcaggttcactgatggacgtgctgcatcacccaggcatgaaccaccgggtagaaatcacagaaggcatattggcggacgaatgtgcggcgctgttgtccgacttttttcgcatgcggaggcaggagatcaaggcccagaaaaaagcacaatcctctactgactctggtggttcttctggtggttctagcggcagcgagactcccgggacctcagagtccgccacacccgaaagttctggtggttcttctggtggttcttccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgacttatcgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcattacccaggcatgaaccaccgggtagaaatcacagaaggcatattggcggacgaatgtgcggcgctgttgtgttacttttttcgcatgcccaggcaggtctttaacgcccagaaaaaagcacaatcctctactgactctggtggttcttctggtggttctagcggcagcgagactcccgggacctcagagtccgccacacccgaaagttctggtggttcttctggtggttctgataaaaagtattctattggtttagccatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtga

SEQ ID NO: 161 - protein, 1584 aa, Artificial Sequence
  Synthetic
MKRTADGSEFESPKKKRKVSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 162 - DNA, 4752 bp, Artificial Sequence
  Synthetic
atgaaacggacagccgacggaagcgagttcgagtcaccaaagaagaagcggaaagtctctgaggtggagttttcccacgagtactggatgagacatgccctgaccctggccaagagggcacgggatgagagggaggtgcctgtgggagccgtgctggtgctgaacaatagagtgatcggcgagggctggaacagagccatcggcctgcacgacccaacagcccatgccgaaattatggccctgagacagggcggcctggtcatgcagaactacagactgattgacgccaccctgtacgtgacattcgagccttgcgtgatgtgcgccggcgccatgatccactctaggatcggccgcgtggtgtttggcgtgaggaactcaaaaagaggcgccgcaggctccctgatgaacgtgctgaactaccccggcatgaatcaccgcgtcgaaattaccgagggaatcctggcagatgaatgtgccgccctgctgtgcgatttctatcggatgcctagacaggtgttcaatgctcagaagaaggcccagagctccatcaactccggaggatctagcggaggctcctctggctctgagacacctggcacaagcgagagcgcaacacctgaaagcagcgggggcagcagcggggggtcagacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 163 - protein, 1789 aa, Artificial Sequence
  Synthetic
MKRTADGSEFESPKKKRKVSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDSGGSKRT

SEQ ID NO: 164 - DNA, 8200 bp, Artificial Sequence
  Synthetic
cttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacactcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatgaaacggacagccgacggaagcgagttcgagtcaccaaagaagaagcggaaagtctctgaagtcgagtttagccacgagtattggatgaggcacgcactgaccctggcaaagcgagcatgggatgaaagagaagtccccgtgggcgccgtgctggtgcacaacaatagagtgatcggagagggatggaacaggccaatcggccgccacgaccctaccgcacacgcagagatcatggcactgaggcagggaggcctggtcatgcagaattaccgcctgatcgatgccaccctgtatgtgacactggagccatgcgtgatgtgcgcaggagcaatgatccacagcaggatcggaagagtggtgttcggagcacgggacgccaagaccggcgcagcaggctccctgatggatgtgctgcaccaccccggcatgaaccaccgggtggagatcacagagggaatcctggcagacgagtgcgccgccctgctgagcgatttctttagaatgcggagacaggagatcaaggcccagaagaaggcacagagctccaccgactctggaggatctagcggaggatcctctggaagcgagacaccaggcacaagcgagtccgccacaccagagagctccggcggctcctccggaggatcctctgaggtggagttttcccacgagtactggatgagacatgccctgaccctggccaagagggcacgcgatgagagggaggtgcctgtgggagccgtgctggtgctgaacaatagagtgatcggcgagggctggaacagagccatcggcctgcacgacccaacagcccatgccgaaattatggccctgagacagggcggcctggtcatgcagaactacagactgattgacgccaccctgtacgtgacattcgagccttgcgtgatgtgcgccggcgccatgatccactctaggatcggccgcgtggtgtttggcgtgaggaacgcaaaaaccggcgccgcaggctccctgatggacgtgctgcactaccccggcatgaatcaccgcgtcgaaattaccgagggaatcctggcagatgaatgtgccgccctgctgtgctatttctttcggatgcctagacaggtgttcaatgctcagaagaaggcccagagctccaccgactccggaggatctagcggaggctcctctggctctgagacacctggcacaagcgagagcgcaacacctgaaagcagcgggggcagcagcggggggtcagacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgtgagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctcagccagagaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagcagtacagaagcaccaaagaggtgctggacgccaccctgatccaccagagcatcaccggcctgtacgagacacggatcgacctgtctcagctgggaggtgactctggcggctcaaaaagaaccg

SEQ ID NO: 165 - DNA, 18 bp, Artificial Sequence
  Synthetic
cacctctcattcagattt

SEQ ID NO: 166 - DNA, 19 bp, Artificial Sequence
  Synthetic
tcacctctcattcagattt

SEQ ID NO: 167 - DNA, 20 bp, Artificial Sequence
  Synthetic
gtggtggttcacctctcatt

SEQ ID NO: 168 - DNA, 21 bp, Artificial Sequence
  Synthetic
gttcacctctcattcagattt

SEQ ID NO: 169 - DNA, 21 bp, Artificial Sequence
  Synthetic
ggttcacctctcattcagatt

SEQ ID NO: 170 - DNA, 23 bp, Artificial Sequence
  Synthetic
tggttcacctctcattcagattt

SEQ ID NO: 171 - DNA, 20 bp, Artificial Sequence
  Synthetic
tcacctctcattcagatttt

SEQ ID NO: 172 - DNA, 20 bp, Artificial Sequence
  Synthetic
tggtggttcacctctcattc

SEQ ID NO: 173 - DNA, 2280 bp, Artificial Sequence
  Synthetic
gacgtcgctagctgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggtggtggttcacctctcattgttttagagctagaaatagcaagttaaaataaggctagtccgttatcaacttgaaaaagtggcaccgagtcggtgctttttttaagcttgggccgctcgaggtacctctctacatatgacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 174 - DNA, 2281 bp, Artificial Sequence
  Synthetic
gacgtcgctagctgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggttcacctctcattcagatttgttttagagctagaaatagcaagttaaaataaggctagtccgttatcaacttgaaaaagtggcaccgagtcggtgctttttttaagcttgggccgctcgaggtacctctctacatatgacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 175 - DNA, 2282 bp, Artificial Sequence
  Synthetic
gacgtcgctagctgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgggttcacctctcattcagatttgttttagagctagaaatagcaagttaaaataaggctagtccgttatcaacttgaaaaagtggcaccgagtcggtgctttttttaagcttgggccgctcgaggtacctctctacatatgacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 176 - DNA, 2283 bp, Artificial Sequence
  Synthetic
gacgtcgctagctgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtggttcacctctcattcagatttgttttagagctagaaatagcaagttaaaataaggctagtccgttatcaacttgaaaaagtggcaccgagtcggtgctttttttaagcttgggccgctcgaggtacctctctacatatgacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 177 - DNA, 2279 bp, Artificial Sequence
  Synthetic
gacgtcgctagctgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtcacctctcattcagatttgttttagagctagaaatagcaagttaaaataaggctagtccgttatcaacttgaaaaagtggcaccgagtcggtgctttttttaagcttgggccgctcgaggtacctctctacatatgacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 178 - DNA, 2278 bp, Artificial Sequence
  Synthetic
gacgtcgctagctgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgcacctctcattcagatttgttttagagctagaaatagcaagttaaaataaggctagtccgttatcaacttgaaaaagtggcaccgagtcggtgctttttttaagcttgggccgctcgaggtacctctctacatatgacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 179 - DNA, 2280 bp, Artificial Sequence
  Synthetic
gacgtcgctagctgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggatgagataatgatgagtcagttttagagctagaaatagcaagttaaaataaggctagtccgttatcaacttgaaaaagtggcaccgagtcggtgctttttttaagcttgggccgctcgaggtacctctctacatatgacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 180 - DNA, 2280 bp, Artificial Sequence
  Synthetic
gacgtcgctagctgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggaagatagagaatagactgcgttttagagctagaaatagcaagttaaaataaggctagtccgttatcaacttgaaaaagtggcaccgagtcggtgctttttttaagcttgggccgctcgaggtacctctctacatatgacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 181 - DNA, 2280 bp, Artificial Sequence
  Synthetic
gacgtcgctagctgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggggaataaatcatagaatccgttttagagctagaaatagcaagttaaaataaggctagtccgttatcaacttgaaaaagtggcaccgagtcggtgctttttttaagcttgggccgctcgaggtacctctctacatatgacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 182 - DNA, 2280 bp, Artificial Sequence
  Synthetic
gacgtcgctagctgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgttcacctctcattcagatttgttttagagctagaaatagcaagttaaaataaggctagtccgttatcaacttgaaaaagtggcaccgagtcggtgctttttttaagcttgggccgctcgaggtacctctctacatatgacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 183 - DNA, 2280 bp, Artificial Sequence
  Synthetic
gacgtcgctagctgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtcacctctcattcagattttgttttagagctagaaatagcaagttaaaataaggctagtccgttatcaacttgaaaaagtggcaccgagtcggtgctttttttaagcttgggccgctcgaggtacctctctacatatgacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 184 - DNA, 2280 bp, Artificial Sequence
  Synthetic
gacgtcgctagctgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtggtggttcacctctcattcgttttagagctagaaatagcaagttaaaataaggctagtccgttatcaacttgaaaaagtggcaccgagtcggtgctttttttaagcttgggccgctcgaggtacctctctacatatgacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 185 - DNA, 25 bp, Homo sapiens
ccaaaatctgaatgagaggcgaacc

SEQ ID NO: 186 - DNA, 25 bp, Artificial Sequence
  Synthetic
ccaaaatctgaatgagaggtgaacc

SEQ ID NO: 187 - protein, 6 aa, Artificial Sequence
  Synthetic
QNLNRE

SEQ ID NO: 188 - DNA, 25 bp, Artificial Sequence
  Synthetic
ggttcacctctcattcagattttgg

SEQ ID NO: 189 - DNA, 23 bp, Artificial Sequence
  Synthetic
ttcacctctcattcagattttgg

SEQ ID NO: 190 - DNA, 25 bp, Artificial Sequence
  Synthetic
ggttcgcctctcattcagattttgg

What is claimed is:

1. An isolated nucleic acid comprising a transgene flanked by adeno-associated virus (AAV) inverted terminal repeats (ITRs), wherein the transgene encodes a mini-Protocadherin related 15 (mini-PCDH15) protein comprising an amino acid sequence at least 95% identical to SEQ ID NO: 95 or 99.

2. The isolated nucleic acid of claim 1, wherein the mini-PCDH15 protein comprises the amino acid sequence of SEQ ID NO: 95.

3. The isolated nucleic acid of claim 2, wherein amino acid sequence of SEQ ID NO: 95 is encoded by the nucleic acid sequence of SEQ ID NO: 97.

4. The isolated nucleic acid of claim 1 further comprising a promoter operably linked to the transgene encoding the mini-PCDH15 protein.

5. The isolated nucleic acid of claim 4, wherein the promoter is a cytomegalovirus (CMV) promoter, a hybrid cytomegalovirus (CMV) immediate-early/chicken beta-actin (CAG) promoter, a chicken beta actin (CBA) promoter, or a minimal promoter.

6. The isolated nucleic acid of claim 4, wherein the promoter is a Methyl-CpG Binding Protein 2 (MeCP2) promoter, a Ubiquitin-C (UbiC) promoter, a Bestrophin 1(Best1) (retina native) promoter, a human red opsin (RedO) promoter, a human rhodopsin kinase (RK) promoter, a mouse cone arrestin (CAR) promoter, a human rhodopsin (Rho) promoter, a UV opsin-specific 1 (opn1sw1) promoter, a UV opsin-specific 2 (opn1sw2) promoter, an Opsin 1, Medium Wave Sensitive 2 (opn1mw2) promoter, an opsin 1, long2 wave-sensitive 1 (opn1lw1) promoter, a blue cone specific (sws2) promoter, an L-opsin (opn1lw1-cxxc1) promoter, a thyroid hormone receptor β (thrb) promoter, an LIM Homeobox 1a (Ihx1a) promoter, a connexin 55.5 (cx55.5) promoter, a metabotropic glutamate receptor 6b (grm6b) promoter, a glial fibrillar acidic protein (gfap) promoter, a cone transducin alpha subunit (gnat2) promoter, a connexin 52.7 (cx52.7) promoter, a connexin 52.9 (cx52.9) promoter, a heat shock cognate 70-kd protein,-like (hsp70l) promoter, a yeast transcription activator protein-(GAL4-VP16) promoter, an upstream activation sequence (UAS), a visual system homeobox 1 (vsx1) promoter, or a rhodopsin (zop) promoter.

7. The isolated nucleic acid of claim 5, wherein the minimal promoter is a minimal CMV promoter, a CMV584 bp promoter, or a JeT promoter.

8. The isolated nucleic acid of claim 1, wherein the AAV ITRs are AAV2 ITRs.

9. A vector comprising the isolated nucleic acid of claim 1.

10. An isolated host cell comprising the isolated nucleic acid of claim 1.

11. A pharmaceutical composition comprising the isolated nucleic acid of claim 1 and a pharmaceutically acceptable carrier.

12. The isolated nucleic acid of claim 1, wherein the mini-PCDH15 protein comprises the amino acid sequence of SEQ ID NO: 99.

13. The isolated nucleic acid of claim 12, wherein the amino acid sequence of SEQ ID NO: 99 is encoded by the nucleic acid sequence of SEQ ID NO: 101.

14. The isolated nucleic acid of claim 1, wherein the mini-PCDH15 protein comprises an amino acid sequence at least 98% identical to SEQ ID NO: 95 or 99.

15. The isolated nucleic acid of claim 1, wherein the mini-PCDH15 protein comprises an amino acid sequence at least 99% identical to SEQ ID NO: 95 or 99.

* * * * *